United States Patent 11,141,474 (ARTIFICIAL NUCLEIC ACID MOLECULES ENCODING A NOROVIRUS ANTIGEN AND USES THEREOF) - sequence listing, part 5

SEQ ID NO: 10422 - RNA, 1626 nt, Artificial Sequence
  derived and/or modified sequence opt1 from capsid_protein__Norovirus__ABU55622
augcgcaugagcgacggcgccacccccaaggccaacggguccgaggcgagcggccaggaccuggugccgaccgccgucgagcaggccgugcccauccagcccguggccggggccgcgcucgccgcccccgccgcgggccagaucaaccagaucgacccguggaucuuccagaacuucguccagugcccccugggggaguucuccaucagcccccggaacacgcccggcgagauccuguucgaccucgcccugggcccggggcugaaccccuaccucgcccaccuguccgccauguacaccggcuggguggggaacauggaggugcagcugguccucgccggcaacgcguucaccgccgggaaggugguggucgcccuggugccgcccuacuuccccaagggcagccugaccacggcccagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgcggccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcacgucgacggcacccugcugggcaccaccccgaucagcggguccugggugagcugcuucgccgcggaggccgccuacgaguuccaguccggcacgggggaggucgccaccuucacccucaucgagcaggacggcagcgccuacgugcccggggaccgggcggcgccccugggcuacccggacuucuccggccagcuggagaucgaggugcagaccgagacgaccaagaccggggacaagcucaaggucaccacguucgagaugauccugggccccaccaccaacguggaccaggcccccuaccaggggcgcguguucgccagcgucaccgccgccgccagccuggaccucguggacggccgggugcgcgccgucccccgguccaucuacggguuccaggacacgaucccggaguacaacgacggccugcuggugccccucgccccgcccaucggccccuuccugcccggggaggugcugcuccgcuuccggaccuacaugcgccagcuggacaccgcggacgccgccgccgaggccaucgacugcgcgcugccccaggaguucgucagcugguucgccuccaacgccuucaccgugcagagcgaggcccuccugcugcgguaccgcaacacgcucaccggccagcugcuguucgagugcaagcuguacuccgagggguacaucgcccucagcuacuccggcagcgggucccugaccuuccccaccgacggcuucuucgagguggucagcugggugccgcgccuguaccagcucgcguccgugggcagccuggccacggggcggacccugaagcaguga

SEQ ID NO: 10423 - RNA, 1623 nt, Artificial Sequence
  derived and/or modified sequence opt1 from capsid_protein__Norovirus__ABU55628
augcgcaugagcgacggcgccgugcccaaggccaacggguccgaggcgagcggccaggaccuggucccgaccgccguggagcaggccgugcccauccagcccgucgccggggccuccaucgcggcccccgccgccggccagaucaaccagaucgacccguggaucuuccagaacuucgugcagugcccccucggggaguucagcaucagcccccggaacacccccggcgagauccuguucgaccuggcgcucggcccggggcugaaccccuaccuggcccaccucuccgccauguacacgggcuggguggggaacauggagguccagcuggugcuggccggcaacgccuucaccgcggggaagguggucguggcccucgugccgcccuacuuccccaagggcucccugaccaccgcccagaucacgugcuucccccacgucaugugcgacgugcgcacccuggagcccauccagcucccccugcuggacgugcggcgcguccucuggcacgccacccaggaccaggaggagagcaugcggcuggugugcaugcuguacaccccgcuccgcacgaacucccccggcgacgagagcuucguggucuccgggcggcugcugagcaagcccgccgcggacuucaacuucguguaccucacgcccccgaucgagcgcaccaucuaccggaugguggaccugcccguccugcagccccgccucugcacccacgcccgguggcccgccccgaucuacggccugcugguggaccccucccuccccagcaacccccaguggcagaacgggcgcgugcacgucgacggcacccugcugggcaccaccccgguguccgggagcugggucuccugcuucgccgccgaggcggccuacgaguuccagagcggcaccggggagguggccacguucacccucaucgagcaggacggcuccgccuacgugcccggggaccgggccgcgccccugggcuacccggacuucagcggccagcuggagaucgagguccagaccgagaccacgaagaccggggagaagcucaaggugaccaccuucgagaugauccugggccccgccacgaacguggaccaggcccccuuccaggggcgcgucuacgccagccugaccgcgguggccucccucgaccugguggacggccggguccgcgccgugccccggagcaucuacgccuuccaggacgugaucccggaguacaacgacgggcugcucgucccccuggccccgcccaucggccccuuccugcccggcgagcuccugcugcgcuuccggaccuacaugcgccagaucgacuccagcgacgcggccgccgaggccaucgacugcgcccucccccaggaguucaucuccugguucgcgagcaacgccuucaccgugcaguccgaggcccugcugcuccgguaccgcaacacgcugaccgggcagcugcuguucgagugcaagcucuacagcgagggcuacaucgcccuguccuacagcggguccggcccccugaccuucccggccgacggguucuucgagguggucagcugggugccccgccucuuccagcuggcguccgugggcagcuccgccaccggccggacgcugaaguga

SEQ ID NO: 10424 - RNA, 1593 nt, Artificial Sequence
  derived and/or modified sequence opt1 from capsid_protein__Norovirus__ABW74121
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcagcgggaccggcgacuccuucgugguggccgggcgggucaugaccugccccagcccggacuucaacuuccuguuccucgugccgcccacgguggagcagaagacccgccccuucacccugcccaaccugccccucuccagccuguccaacagccgggcgccccugcccaucuccggcaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucaacuccggcaacuacaucgggguccugagcuggguguccccgcccagccaccccuccggcagccagguggaccuguggaagauccccaacuacggguccagcaucaccgaggccacgcaccucgcccccuccgucuucccgcccggcuucggggaggugcugguguucuucaugagcaagauccccggccccggcgccuacucccugcccugccuccugccgcaggaguacaucagccaccuggccuccgagcaggcgcccaccgucggggaggccgcccuccugcacuacguggaccccgacaccggccggaaccugggggaguucaaggccuaccccgacggcuuccugaccugcgugccgaacggcgccagcagcgggccccagcagcuccccaucaacggcgucuucguguucguguccugggucagccgcuucuaccagcugaagcccguggggacggcguccaccgcccggggccgccucgggcugcggcgcuga

SEQ ID NO: 10425 - RNA, 1593 nt, Artificial Sequence
  derived and/or modified sequence opt1 from capsid_protein__Norovirus__ABW74123
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcggcauggggaucuccccggacaacguccagagcgugcaguuccagaacggccgcugcacccucgacgggcggcuggugggcacgacccccgucagccugucccacguggccaagauccgcgggaccagcaacggcaccgucaucaaccucacggagcuggacggcacccccuuccaccccuucgaggggccggcccccaucggcuuccccgaccucgggggcugcgacuggcacaucaacaugacccaguucgggcacuccagccagacccaguacgacguggacacgaccccggacaccuucgugccccaccucggcuccauccaggccaacggcaucaacagcgggaacuacaucggcguccuguccugggugagcccgcccucccaccccagcgggucccagguggaccuguggaagauccccaacuacggcagcuccaucaccgaggccacgcaccucgcccccagcgucuucccgcccggguucggcgaggugcugguguucuucauguccaagauccccggccccggggccuacagccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcugcccaucaacggggucuucguguucgugagcugggucucccgcuucuaccagcugaagcccgugggcacggcgagcaccgcccgggggcgccucggccugcggcgcuga

SEQ ID NO: 10426 - RNA, 1593 nt, Artificial Sequence; identical to SEQ ID NO: 10425
  derived and/or modified sequence opt1 from capsid_protein__Norovirus__ABW74124

SEQ ID NO: 10427 - RNA, 1593 nt, Artificial Sequence; identical to SEQ ID NO: 10425
  derived and/or modified sequence opt1 from capsid_protein__Norovirus__ABW74125

SEQ ID NO: 10428 - RNA, 1593 nt, Artificial Sequence; identical to SEQ ID NO: 10425
  derived and/or modified sequence opt1 from capsid_protein__Norovirus__ABW74126

SEQ ID NO: 10429 - RNA, 1593 nt, Artificial Sequence; identical to SEQ ID NO: 10425
  derived and/or modified sequence opt1 from capsid_protein__Norovirus__ABW74127

SEQ ID NO: 10430 - RNA, 1593 nt, Artificial Sequence; identical to SEQ ID NO: 10425
  derived and/or modified sequence opt1 from capsid_protein__Norovirus__ABW74128

SEQ ID NO: 10431 - RNA, 1620 nt, Artificial Sequence
  derived and/or modified sequence opt1 from capsid_protein__Norovirus__ABW74532
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacgugaucgucgacgugcggcagcuggagcccgugcucaucccgcugcccgacguccgcaacaacuucuaccacuacaaccaggcccacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucacgguccccauccugaccguggaggagauguccaacagccgguuccccaucccccuggagaagcucuacaccggcccguccagcgacuucgugguccagccccagaacgggcgcugcaccacggacggcgugcugcuggggaccacccagcucuccgccgucaacaucugcaacuucaagggcgacgugacccacaucgccggcagccgggacuaccgcaugaaccuggugucccagaacuggaacaacuacgaccccacggaggagaucccggcgccccuggggacccccgacuuccagggcaagauccaggggcuccugacccagaccacgggcgccgacgggagcacccgggcccacaaggccaccgucagcaccggcgccgccaacuucacgcccaagcugggcuccgugcaguucaccaccgacaccgacaacgacuuccagacggggcagaacaccaaguucaccccggugggcgucauccaggacgggagccaccaccagaacgagccccagcagugggugcuccccaacuacuccggccgcaccgugcacaacguccaccuggcgcccgccguggccccgacguuccccggggagcagcuccuguucuuccggagcaccaugcccggcugcuccggcuaccccaacaugaaccuggacugccugcucccgcaggagugggugaugcacuucuaccaggaggccgcgcccgcccagagcgacgucgcccugcugcgcuucgugaaccccgacaccgggcggguccucuucgagugcaagcugcacaaggccggcuacaucaccguggcccacacggggcagcacgaccuggugaucccgcccaacggcuacuuccgcuucgacuccugggugaaccaguucuacacccucgcgcccauggggaacggcgccggccggcgccgggcccuguga

SEQ ID NO: 10432 - RNA, 1620 nt, Artificial Sequence
  derived and/or modified sequence opt1 from capsid_protein__Norovirus__ABW74533
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcggcgacgggagcacgcgggcccacaaggccaccgucagcaccggcuccgugcacuucacccccaagcugggcagcgugcaguucacgaccgacaccaacaacgacuuccagaccgggcagaacacgaaguucacccccgucggcgugauccaggacggggacaaccaccagaacgagccgcagcagugggugcugcccaacuacuccggccgcaccgggcacaacguccaccucgcccccgccguggcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacgucgcgcuccugcgcuucgugaaccccgacaccggccgggugcuguucgagugcaagcuccacaaguccggguacgucaccguggcccacaccggcccccacgaccuggugaucccgcccaacggguacuuccgcuucgacagcugggucaaccaguucuacacccuggcccccaugggcaacggcacggggcggcgccgggcccucuga

SEQ ID NO: 10433 - RNA, 1623 nt, Artificial Sequence
  derived and/or modified sequence opt1 from capsid_protein__Norovirus__ABW74534
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgcggcccuucaccguccccauccugaccguggaggagaugaccaacucccgcuuccccaucccccuggagaagcuguucacgggcccgagcggggccuucgugguccagccccagaacggccggugcaccaccgacggggugcugcugggcaccacgcagcucucccccgucaacaucugcaccuuccgcggcgacgugacccacaucgccgggacccacgacuacacgaugaaccuggccagccagaacuggaacaacuacgacccgaccgaggagauccccgcgccccugggcacccccgacuucguggggaagauccagggcguccucucccagaccacgcgcggggacggcagcacccggggccacaaggccaccguguccaccgggagcgugcacuucacgccgaagcugggcagcguccaguucaccaccgacaccaacaacgaccuggagacggggcagaacaccaaguucacccccgugggcgugguccaggacgggaacuccacccaccagaacgagccccagcagugggugcuccccaacuacagcggccggacgggccacaacgugcaccuggccccggccgucgcccccaccuuccccggggagcagcuccucuucuuccgcuccaccaugcccggcugcagcggguacccgaacaugaaccuggacugccugcucccccaggagugggugcagcacuucuaccaggaggccgcgcccgcccaguccgacguggcccugcugcgguucgucaaccccgacaccggccgcguccucuucgagugcaagcugcacaagagcggguacgugaccguggcccacacgggccagcacgaccuggugaucccgcccaacggcuacuuccgguucgacuccugggugaaccaguucuacacccucgcgcccauggggaacggcgccgggcgccggcgcgcccuguga

SEQ ID NO: 10434 - RNA, 1623 nt, Artificial Sequence; identical to SEQ ID NO: 10324
  derived and/or modified sequence opt1 from capsid_protein__Norovirus__ABW74535

SEQ ID NO: 10435 - RNA, 1620 nt, Artificial Sequence
  derived and/or modified sequence opt1 from capsid_protein__Norovirus__ABW74536
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagacgauccucgccgggaacgccuucaccgcgggcaagaucaucuucgccgccgucccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgaccccacgaucaagcugaucgccaugcucuacacgccccugcgggccaacaacgcgggcgacgacgucuucaccgugagcugccgcgugcugacccggccgucccccgacuucgacuucaucuuccucgucccgcccaccguggagagccgcaccaagcccuucaccgugcccauccugaccgucgaggagauguccaacagccgguuccccaucccccuggagaagcucuacacgggcccguccagcgccuucguggugcagccccagaacgggcgcugcaccaccgacggcguccugcuggggaccacgcagcucuccgccgugaacaucugcaccuuccggggcgacgucacccacaucgccggcagccacgacuacaccaugaaccuggccucccagaacuggaacaacuacgaccccacggaggagaucccggcgccccuggggacccccgacuucgugggcaagauccaggggaugcucacccagaccacgcgcgaggacggcagcacccgggcccacaaggccaccgugagcaccggguccguccacuucacgcccaagcugggcagcgugcaguacaccaccgacaccaacaacgacuuccaggccggccagaacacgaaguucaccccggugggggucauccaggacggcaacaaccaccagaacgagccccagcagugggugcugcccaacuacuccgggcgcaccggccacaacgugcaccucgcccccgcggucgccccgaccuuccccggggagcagcugcuguucuuccggagcacgaugcccggcugcuccggcuaccccaacaugaaccucgacugccugcugccgcaggagugggugcagcacuucuaccaggaggccgcccccgcgcagagcgacguggcccuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcacgggccggcgccgggcccucuga

SEQ ID NO: 10436 - RNA, 1623 nt, Artificial Sequence
  derived and/or modified sequence opt1 from capsid_protein__Norovirus__ABW74537
augaagauggccagcaacgacgccucccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucccgggcacccgcacguaccggaugaaccuggccucccagaacuggaacaacuacgaccccaccgaggagauccccgcgccccuggggaccccggacuucgugggcaagauccaggggaugcucacccagacgaccaagggcgacgggagcacccgcggccacaaggccaccgucuccacgggcagcguggacuucacccccaagcuggggagcgugcaguucgccaccgacaccgacaacgacuucgagacgggccagaacacccgguucacccccgucggggugauccaggacggcuccagcgcccaccgcaacgagccccagcagugggugcugccggacuacuccgggcggaccguccacaacgugcaccucgcccccgccguggcccccacguuccccggcgagcagcugcuguucuuccgcagcaccaugccgggcugcuccggguaccccaacauggaccucgacugccugcugccccaggaguggguccagcacuucuaccaggaggcggcccccgcccagagcgacguggcccuccugcgguucgugaacccggacaccggccgcguccuguucgagugcaagcuccacaagaccggguacgugaccguggcgcacacgggccagcacgaccuggucaucccgcccaacggguacuuccgguucgacuccugggugaaccaguucuacacccuggcccccaugggcaacggcgccgggcgccgccgggcccucuga

SEQ ID NO: 10437 - RNA, 1623 nt, Artificial Sequence
  derived and/or modified sequence opt1 from capsid_protein__Norovirus__ABW74538
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgacgacguguucaccgugagcugccgcguccucacccggccgucccccgacuucgacuucaucuuccuggugccgcccaccguggagagccgcacgaagcccuucaccguccccauccugaccguggaggagaugaccaacucccgguuccccaucccccucgagaagcuguucacgggcccgagcggggccuucgugguccagccccagaacggccgcugcaccaccgacggggugcugcucggcaccacgcagcugucccccgucaacaucugcaccuuccggggcgacgugacccacaucgccgggacccacgacuacacgaugaaccuggccagccagaacuggaacaacuacgacccgaccgaggagauccccgcgccccucggcacccccgacuucguggggaagauccagggcguccugacccagacgacccgcggggacggcuccacccggggccacaaggccaccgugagcacgggguccgugcacuucaccccgaagcugggcagcguccaguucaccaccgacacgaacaacgaccucgagaccgggcagaacacccgcuucacccccgugggcgugguccaggacgggaacagcacgcaccagaacgagccccagcagugggugcugcccaacuacuccggccgggccggccacaacgugcaccuggccccggccgucgcccccaccuuccccggggagcagcuccuguucuuccgcagcaccaugcccggcugcuccggguacccgaacaugaaccuggacugccuccugccccaggagugggugcagcacuucuaccaggaggcggcccccgcccagagcgacguggcccugcuccgguucgucaaccccgacaccggccgcgugcuguucgagugcaagcugcacaaguccggguacgugaccgucgcgcacacgggccagcacgaccucgugaucccgcccaacggcuacuuccgguucgacagcugggugaaccaguucuacacccuggcccccauggggaacggcgccgggcgccggcgcgcccuguga

SEQ ID NO: 10438 - RNA, 1623 nt, Artificial Sequence
  derived and/or modified sequence opt1 from capsid_protein__Norovirus__ABW74539
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcuccugggcaccacgcagcucucccccgucaacaucugcaccuuccggggcgacgugacccacaucgccgggacccgcaacuacacgaugaaccuggccagccagaacuggaacaacuacgaccccaccgaggagaucccggcgccccugggcacccccgacuucguggggcggauccagggcaugcucacccagacgacccgccgggacggguccacccgcggccacaaggccaccgucagcacgggcgacgcccacuucacccccaagcugggguccaucauguucagcaccgacaccgacaacgacuucgagacgggccagaacaccaaguucaccccggugggggugguccaggacggcaacgggacccaccagaacgagccccagcagugggugcugcccagcuacuccggccggacgggccacaacgugcaccucgcccccgccgucgccccgaccuuccccggggagcagcugcuguucuuccgcagcaccaugcccggcugcuccggguaccccaacaugaaccucgacugccugcugccgcaggagugggugcagcacuucuaccaggaggcggcccccgcccagagcgacguggcccuccugcgguucgucaaccccgacaccggccgcgugcuguucgagugcaagcuccacaaguccggguacgugaccgucgcgcacacgggccagcacgaccuggugaucccgcccaacggcuacuuccgguucgacagcugggugaaccaguucuacacccuggcccccauggggaacggcaccgggcgccgccgggcccucuga

SEQ ID NO: 10439 - RNA, 1623 nt, Artificial Sequence; identical to SEQ ID NO: 9307
  derived and/or modified sequence opt1 from capsid_protein__Norovirus__ABW74540

SEQ ID NO: 10440 - RNA, 1623 nt, Artificial Sequence
  derived and/or modified sequence opt1 from capsid_protein__Norovirus__ABW74541
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccagcuucgugguccagccccagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggcaagauccaggggguccucacccagacgacccgcggcgacggguccacccggggccacaaggccaccgugagcacgggcagcgugcacuucaccccgaagcugggguccguccaguucagcaccgacaccuccaacgacuucgagacgggccagaacacccgcuucacccccgugggggugguccaggacggcagcaccacgcaccagaacgagccccagcagugggugcugcccgacuacuccgggcggaacagccacaacgugcaccucgccccggccgucgcccccaccuuccccggcgagcagcugcuguucuuccgcuccaccaugcccggcugcagcggguacccgaacaugaaccucgacugccugcugccccaggagugggugcagcacuucuaccaggaguccgcccccgcccagagcgacguggcgcuccugcgguucgucaaccccgacaccggccgcgugcuguucgagugcaagcuccacaaguccggguacgugaccgucgcccacacgggccagcacgaccuggugaucccgcccaacggguacuuccgguucgacagcugggugaaccaguucuacacccuggcccccaugggcaacggcgccgggcgccggcgcgcgcucuga

SEQ ID NO: 10441 - RNA, 1623 nt, Artificial Sequence
  derived and/or modified sequence opt1 from capsid_protein__Norovirus__ABW74542
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcgccuucgugguccagccgcagaacgggcgcugcaccacggacggcgugcuccuggggaccacccagcucucccccgucaacaucugcaccuuccggggcgacgugacgcacaucgccggcacccaggaguacaccaugaaccuggccagccagaacuggaacaacuacgaccccaccgaggagaucccggcgccccuggggacgcccgacuucgugggcaagauccaggggguccucacccagaccacccgccgggacggcuccacgcgcgggcacaaggccaccgugagcaccggcagcgugcacuucacccccaagcugggccggauccaguucuccacggacaccagcaacgacuucgagaccgggcagaacacccgcuucacgccggucggcguggugcaggacggguccaccacccaccagaacgagccccagcaguggguccugcccaacuacagcggccgggacucccacaacgugcaccucgcccccgccguggccccgagcuuccccggggagcagcugcuguucuuccgcuccaccaugcccggcugcagcggcuaccccaacauggaccucgacugccugcugccgcaggaguggguccagcacuucuaccaggaggcggcccccgcccaguccgacguggcccuccugcgguucgugaaccccgacacggggcgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcaccggccgccgccgggcccucuga

SEQ ID NO: 10442 - RNA, 1623 nt, Artificial Sequence; identical to SEQ ID NO: 9292
  derived and/or modified sequence opt1 from capsid_protein__Norovirus__ABW74544

SEQ ID NO: 10443 - RNA, 1623 nt, Artificial Sequence; identical to SEQ ID NO: 9855
  derived and/or modified sequence opt1 from capsid_protein__Norovirus__ABW74545

SEQ ID NO: 10444 - RNA, 1623 nt, Artificial Sequence
  derived and/or modified sequence opt1 from capsid_protein__Norovirus__ABW74546
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuuccaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 10445 - RNA, 1566 nt, Artificial Sequence
  derived and/or modified sequence opt1 from capsid_protein__Norovirus__ABW75843
augaagaugagcgacaaggaguccgccgagagccccgccucccugggccaggugcucccgccccaggucgacguggugguccccguggagcccaccgugggggcgcagaucgccgccccgaccgccggccagaucaaccccaucgaccccuggaucuucagcaacuucguccaggcgccccagggggaguucacgaucuccccgaacaacaaccccggcgagauccuguucgagauggagcuggggcccgaccucaaccccuaccugggccaccuccgccggauguacaacggcuggaccgggagccugcgcgugcgggugaugcuggccggcaacgccuucuccgccgggaagaucaucgucuucugcaucccgcccggcuucgacaccaccuuccugacgcccgcccaggcgacccaguucccccacgugaucauggacgugcgcgccccggaccccgucgaggugccccucgaggacgugcggaacguccuguuccaccaggggcccgacaaccgcaugcggcuggugggcaugcucuacaccccgcugcgcgccaacagcggcgccgaccccuucguggucaccgggcgggugcugacgugccccuccgagaacuucagcuucuucuuccucgugcccccgaccgucgaggagaaggacgugcccuucaccauccccaacgugcccaccuccagccugacgaacucccgcaugcuggagccggucgccgagcuccggagcucccgcaacuucgcgcugagcgugcaguuccagaacggccgguccaccaucgagggggagcugcucggcaccacccccgccagccuggccgaccugggcuccuuccucugcauccgcgggggcacggccaaccuggccgagcuguuccagcccaacgaggacgcguucgucgccgggagccacccggcccccuucggcuuccccgacuucagcaacugcacccucgacuuccugcuguacgacgccaacgggcucuaccaccggcaccuggacgugaccuccgccagcaacuucacccccgcgcugggccacaucacgcucgacggcuccgugccggaccgccugacccgggcccgccuggaggggguccagcgggccagcgagaacaccuucuggcgcaugcccgacuaccggggcgacgugcucggggccgaguucgcccccgcgguguccgcccccggcaucggggagacccugcuguucuucaugagcaacgucccguaccacaacggcuccaaccccaacccccuccccugccugcugccgcucgaguggaucaaccacuucguggccgagcgccccgccaagcagagcgacguggcgcugcugaacuacaucaacccccucacgggccgcguccuguucgagugcaagcuguacuccgccggguuccucgccgugaaccugggcagccagaccgaggugacccugcccgucgacgggaucuucaaguucguguccugggugagcuacuacuaccagcugcggccggucggcaccguguccguggggcgccggcucccccgccuggacggccacuga

SEQ ID NO: 10446 - RNA, 1737 nt, Artificial Sequence
  derived and/or modified sequence opt1 from capsid_protein__Norovirus__ABX71062
augaagauggccagcaacgacgccgcgcccuccagcgacggcgccgggaaccuggugccggagucccaccaggagguccucccccuggcccccguggccggcgccgcgaucgccgcccccguggucgggcagcagaacaucaucgacccguggaucaaggagaacuucgugcaggcgccccagggcgaguucaccgugagccccaagaacucccccggggagguccuggugaaccucgagcugagcccgaagcugaaccccuaccucgaccaccuguccaagauguacaacgccuacgccggcggcauggagaucgagaucauccuggccgggaacgccuucaccgccggcaaggugcucaucgcggccgucccgcccaacuuccccguggagaacaucagcgugucccaggccagccaguucccccacgucaucguggacgugcgcacgcuggagcccauccggcugccccucccggacguccgcaccaacuucuuccacuacaccacccgggacgagcccaagaugcgcaucguggccuggcuguacacgccccugcggaccaacggguccggcgacgacagcuucaccguguccgggcgcauccucacccggcccagcgccgacuucgaguucuccuuccuggucccgcccacgguggagaccaagaccgugagcuucuccguccccggccugaccguggaggagaugagcaacucccgcuggcccgcgcagaucaacggccucgugguccgggggaacgaggcccaggugguccacuuccagaacggccgcugcacgaccgaggggaugcugcugggcaccaccacgcucaacgugaacagcaucugcggccugcgggggaccagcaucucccacgccagcgugcgcgaggccccggcccuguccgaggagaugccgccccucgaggacgaggucgcgcacggcgccgccgccaccuacgccguggggcgggcggccgacaccacgcuguggauccgcguggaggagcccaacggccagcccuacgacaucuucggggagcagcccgcgccccugggcaccccggacuucaccgccgucaucaucggcaccgccauccggccccgcacggccagcggggccuaccuccacgacgccuacguggacacccggcccggcgacgccgacuucacccccuccaccgggaacacgaagaucgugcugcgcggcgggggcagcggccacgucggggagggccacuacuggcaguucaagccgaucgcgguggagggcgggcccaaccggcccguguaccaggaguacaaccugcccgaguacgccgggccgaccgccuccaaccacaaccucgccccgcccgucgcccccaagaugcccggcgagcugcugcuccuguucgagagcgacaugcccgugugggacaacggcuccgggagcgcgcccacccagaagauccacugccugcuccccaacgacuucgugacccacuucuucgaccugcaggccccggcccuggccgaggccgcgcuccugcgcuacguccaccccgacuccggccggacgcuguucgagugcaagcucuaccgcgagggguacauggugguggucgcccccagcggccgccuggacuucccccuggacggcuacuuccgguucgacuccugggugaacgccuucuacgugcucagcccggucgggaacggccaggggcgccggggccgcgccaagaacaucuga

SEQ ID NO: 10447 - RNA, 1605 nt, Artificial Sequence
  derived and/or modified sequence opt1 from capsid_protein__Norovirus__ABY77754
augaagauggccagcaacgacgccucccccagcuccgacggcagcgcgaaccuggugccggagaucaacaacgaggucauggcccucgagcccguggccggggccgccaucgcggcccccguggccggccagcagaacaucaucgaccccuggauccgcaacaacuucguccaggcccccgggggcgaguucaccgugagcccccggaacgcgcccggggaggugcugcugaaccucccccuguccccggacaucaaccccuaccuggcccaccucucccgcauguacaacggcuacgccggcggggucgagguggaggugguccuggccggcaacgccuucaccgcggggaagaucaucuucgccgccgugccgcccaacuucccgcccgagaaccugagccccucccagaucacgaugcucccccacaucaucguggacguccggcagcuggagccggugcgcaucccccugcccgacgugcggaacaacuucuaccacuacagccgcgagaacgacuccacccuccggcuggucgccaugcuguacacgccccuccgcgccaacaacgcgggcgacgacguguucaccgugagcugccggguccugacccgcccgucccccgacuucgacuucaucuuccuggugccgcccaccguggagagcaaguccaagcccuucaccauccccauccucaccaucgaggagaugacgaacagccgguuccccgcgccccuggagaugaugaccaccgggccgucccacgacaucgucgugcagccccagaacggccgcugcaccaucgacggcgugcugcucgggacgacccagcugagccccgucaacaucugcuccaugcggggcgugccgaccaagcgcaccaacgggacggacaacugcuucguccagcuggagaaccccaacggcagcgccuacgaccccaccgaggacauccccgccgugcucggcagcccggacuucgugggggaguucuacggcaccaucacccagcggucccccaacaacagcacgcgcgcccaccccuucacccugaacaccgggagcccccgguacaccccgaagaucggcuccgucgacauccacgugacggacguggacgaccugaacgaccacgagcccgucaagcucacccccguggggcuguccggcagcuccggcagcauccaccaguggcagcugcccaacuacuccgggguggccacccacaacaugcaccucgccccgagcgucgcgccccuguuccccggcgagcagauccuguucuuccgcuccaccgugcccgggugcggcggguacccgaacacgaacaucgacugccucaucccccaggagugggugcagcacuucuaccaggagggcgcccccgcccggaccgacgucgcccugcugcgcuucaucaaccccgacaccggccggguccucuucgagugcaagcugcacaagcacggguucaucaccguggccuacagcggcaaccacgaccuggugaugccgcccaacggguacuuccgcuucgaguccugggugaaccaguuccacacgcucgcccccaugggcaccgggcgcgccgaggagauccaguga

SEQ ID NO: 10448 - RNA, 1608 nt, Artificial Sequence
  derived and/or modified sequence opt1 from capsid_protein__Norovirus__ABZ89549
augaagauggccagcaacgacgccucccccagcuccgacggcagcgcgaaccuggugccggagaucaacaacgaggucauggcccucgagcccguggccggggccgccaucgcggcccccguggccggccagcagaacaucaucgaccccuggauccgcaacaacuucguccaggcccccgggggcgaguucaccgugagcccccggaacgcgcccggggaggugcugcugaaccucccccuguccccggacaucaaccccuaccuggcccaccucucccgcauguacaacggcuacgccggcggggucgagguggaggugguccuggccggcaacgccuucaccgcggggaagaucaucuucgccgccgugccgcccaacuucccgcccgagaaccugagccccucccagaucacgaugcucccccacaucaucguggacguccggcagcuggagccggugcgcaucccccugcccgacgugcggaacaacuucuaccacuacagccgcgagaacgacuccacccuccggcugaucgccaugcuguacacgccccuccgcgccaacaacgcgggcgacgacgucuucaccgugagcugccgggugcugacccgcccgucccccgacuucgacuucaucuuccuggucccgcccaccguggagagcaaguccaagcccuucaccauccccauccucaccaucgaggagaugacgaacagccgguuccccgcgccccuggagaugaugaccaccgggccgucccacgacaucgugguccagccccagaacggccgcugcaccaucgacggcgugcugcucgggacgacccagcugagccccgugaacaucugcuccaugcggggcgucccgaccaagcgcaccaacgggacggacaacugcuucgugcagcuggagaaccccaacggcagcgccuacgaccccaccgaggacauccccgccguccucggcagcccggacuucgugggggaguucuacggcaccaucacccagcggucccccaacaacagcacgcgcgcccaccccuucacccugaacaccgggagcccccgguacaccccgaagaucggcuccguggacauccacgucacggacguggaggaccugaacgaccacgagcccgugaagcucacccccgucgggcuguccggcagcuccggcagcauccaccaguggcagcugcccaacuacuccgggguggccacccacaacaugcaccucgccccgagcguggcgccccuguuccccggcgagcagauccuguucuuccgcuccaccguccccgggugcggcggguacccgaacacgaacaucgacugccucaucccccaggagugggugcagcacuucuaccaggagggcgcccccgcccggaccgacguggcccugcugcgcuucgucaaccccgacaccggccggguccucuucgagugcaagcugcacaagcacggguucaucaccguggccuacagcggcaaccacgaccuggugaugccgcccaacggguacuuccgcuucgaguccugggugaaccaguuccacacgcucgcccccaugggcaccgggagcggccgccggcgcauccaguga

SEQ ID NO: 10449 - RNA, 1644 nt, Artificial Sequence
  derived and/or modified sequence opt1 from capsid_protein__Norovirus__ACC69023
augaagauggccagcaacgacgcgcccccguccaccgacggcagcgcggggcuggugcccgaggucaacaacgagaccauggcccucgagcccguggugggcgcgccccuggccgccccggucgccgggcagcacaacaucaucgaccccuggaucaagaugaacuucgugcaggcccccaacggcgaguucacggugagcccccgcaacgccccgggggagauccugcucgaccuggagcugggccccgaccucaaccccuaccugucccaccuggcccggauguacaacggcuacgccgggggcauggaggcccaggucgugcucgccgggaacgccuucaccgccggcaagaucaucuucgcggccgugcccccgaacuuccccgccgagaaccuguccgccgcccaggucaccaugugcccccacgugaucguggacguccgccagcuggagcccgugaugcucccgaugcccgacauccggaacaagcuguuccacuacaaccagguggacgaccccaagcugcgccuccuggcguaccuguacacgccccuccgggccaacaacgccggggacgacgucuucaccgugagcugccgcgugcugacccggccgacccccgacuucgaguucauguuccuggucccgcccaccguggaguccaagacgaagcccuucagccuccccggccugacccuggacgagcucuccaacagccgcuuccccgcccccaucgugcagcuguacaccaacccgcacgacaaccuggucgugcagccccagaacggccggugcaccaucgacgggcuccugcagggcacgacccagcugguguccugcaacgucugcagcuaccgcgggaccaucggcggcgggcagcccgccucccacaccgaggaggagaucaugccgauggcguucaacauccagcgggagaucaugcucgagaaccuggacggcagccccuacgaccccguggacgacauccccgccguccugggguccccggacuuccagggcgugguguucgggauccucagccagcgcaacgccaacggccagacgcgggcccacgaggccaaggucgacacccgcgcggcccgguucgcccccaagcugggcuucgugguggccaccgucgaguccaccgacuuccacgacaaccagcccagccgcuucgcgcccguggggcugggcgggaacggcaaccaggacuucaaccagugggcccucccggccuacgggggcgcccugacgaacaacaccaaccuggccccgcccgugaugcccgucuaccccggcgagcagcuccuguucuuccggucccagcugcccagcagcgggggcguggucgggggcuggcucgacugccugcugccccaggagugggugcagcacuucuuccaggaguccgcgaccagccaguccgacguggcccucgugcgcuacaucaaccccaccacggggcggguccuguucgaggccaagcugcacaagcagggcuuccucaccguggccgccagcggcuccuacccgcuggugguccccgcggacggguacuuccgcuucgagagcugggugaaccaguucuacacccuggcccccaugggcaacggguccggccggcgccgcgcccgguga

SEQ ID NO: 10450 - RNA, 1644 nt, Artificial Sequence
  derived and/or modified sequence opt1 from capsid_protein__Norovirus__ACC69026
augaagauggccagcaacgacgcgcccccguccaccgacggcagcgcggggcuggugcccgaggucaacaacgagaccauggcccucgagcccguggugggcgcgccccuggccgccccggucgccgggcagcacaacaucaucgaccccuggaucaagaugaacuucgugcaggcccccaacggcgaguucacggugagcccccgcaacgccccgggggagauccugcucgaccuggagcugggccccgaccucaaccccuaccugucccaccuggcccggauguacaacggcuacgccgggggcauggagguccagguggugcucgccgggaacgccuucaccgccggcaagaucaucuucgccgcggugcccccgaacuuccccgccgagaaccuguccgccgcccaggugaccaugugcccccacgugaucgucgacgugcgccagcuggagcccgugaugcucccgaugcccgacauccggaacaagcuguuccacuacaaccaggucgacgaccccaagcugcgccuccuggccuaccuguacacgccccuccgggcgaacaacgccggggacgacguguucaccgugagcugccgcguccugacccggccgacccccgacuucgaguucauguuccuggugccgcccaccguggaguccaagacgaagcccuucagccuccccggccugacccuggacgagcucuccaacagccgcuuccccgcccccaucguccagcuguacaccaacccgcacgacaaccugguggugcagccccagaacggccggugcaccaucgacgggcuccugcagggcacgacccagcuggucuccugcaacgugugcagcuuccgcgggaccaucggcggcgggcagcccgccucccacagcgaggaggagaucaugccgauggccuucaacauccagcgggagaucaugcucgagaaccuggacggcucccccuacgaccccgcggacgacauccccgccguccuggggagcccggacuuccagggcgugguguucgggauccucucccagcgcaacgccagcggccagacccgggcccacgaggccaaggucgacacgcgcgcggcccgguucgcccccaagcugggcuucgugguggccaccgucgaguccaccgacuuccacgacaaccagcccagccgcuucacccccguggggcugggcgggaacggcaaccaggacuucaaccagugggcgcucccggccuacgggggcgcccugacgaacaacaccaaccuggccccgcccgugaugcccgucuaccccggcgagcagcuccuguucuuccggagccagcugcccuccagcgggggcguggucgggggcuggcucgacugccugcugccccaggaguggguccagcacuucuuccaggaguccgccaccagccaguccgacguggcgcucgugcgcuacaucaaccccaccacggggcggguccuguucgaggccaagcugcacaagcagggcuuccucaccguggccgccagcggcuccuacccgcuggugguccccgccgacggguacuuccgcuucgagagcugggugaaccaguucuacacccuggcgcccaugggcaacggguccggccggcgccgcgcccgguga

SEQ ID NO: 10451 - RNA, 1671 nt, Artificial Sequence
  derived and/or modified sequence opt1 from capsid_protein__Norovirus__ACC69028
augaagauggccagcaacgacguggccgcgcccuccaccgacggcagcgccgggcugguccccgaggugaacaacgagaccauggcccucgagcccguggccggcgccgcgcuggccgcccccgucguggggcagcacaacgugaucgaccccuggauccgcggcaacuucguccaggccccgaacggggaguucacggugagcccccggaacucccccggcgaggugcugcucaaccuggagcugggccccgagcucaacccguaccuggcgcaccuggcccgcauguacaacggguacgccggcgggauggagguccagguggugcucgccggcaacgccuucgcggccgggaagaucaucuucgccgccgucccgcccuccuuccccguggacgcccugagcgcgcccaccaucaccaugugcccccacgugaucgucgacgugcggcagcuggagcccgugcuccugcccaugccggacguccgcaacaacuucuuccacuacaaccaguccagcgaccccaagcugcggcucguggccaugcuguacacgccccugcgcgccaacucccccaccgacgacguguucaccgucagcugccgggugcucacccgcccgucccccgacuucgaguucaccuuccugaucccgcccacgguggagagcaaguccaagccccugaccaucccccagcucacccugagcgagcuguccaacagccgguuccccgcccccaucgacaugcucaacaccuccccgaacgacaacaucgucgugcagccccagaacggccgcugcacgcuggacggcgagcugcaggggaccacccagcuccagcccagccugaucugcuccuuccggggcgucgugcugaacgagaccagccgcauggccguggacuacgaggaggaggaggagguccagcggccgcaggcgcgcgccuucaaccacgaguaccaccuccagcugcagaaccuggacgggacggacuacgaccccgccggcgaccuccccgccacccugggcgcccccgacuucguggggaccguguacggcgucgugagccagcggaccacgcgcgacuccgcggcccgggcccacgaggccaagaucaucaccaacgacccgcgcuacgcgcccaagcuggggagcguggaguucgucaccgaguccaccgacaucgugaucaacgaccagacgaaguucacccccgugggccucgcccacaaccgggccgucgacuacaagcagugggagcugccccacuacgccggggagcugaccgccaacaccaaccucgcgccgcccguggcccccguguaccccggcgagcagcugcuguucuuccgcagcaaccucccgcuggccggcgggacggccgccuccguccuggacuaccuccugccccaggaguggauccagcacuucuaccaggagagcuucacgccccaguccgacaucgcgcugcuccgguacgugaaccccgacaccggccgcgugcuguucgaggccaagcugcaccgccagggguacaucaccgucgccggcgccgggaccagcccgguggccgugccgcccaacggcuacuuccgguucgaguccugggucagccaguucuacgcgcuggcccccaugggcuccgggaccggccgccggcgcaaccaguga

SEQ ID NO: 10452 - RNA, 1626 nt, Artificial Sequence
  derived and/or modified sequence opt1 from capsid_protein__Norovirus__ACC96732
augggcaugagcgacggggccgcccccaaggcgaacggcuccgaggccagcgggcaggaccuggugccgaccgccgucgagcaggccgugcccauccagcccguggccggcgcggcccucgccgcccccgcggccgggcagaucaaccagaucgacccguggaucuuccagaacuucguccagugcccccugggcgaguucuccaucagcccccgcaacacccccggcgagauccuguucgaccucgcccuggggccgggccugaaccccuaccucgcccaccuguccgccauguacacggggugggugggcaacauggaggugcagcugguccucgcggggaacgccuucaccgccggcaaggugguggucgcccuggugccgcccuacuuccccaagggcagccugaccaccgcccagaucacgugcuucccccacgugaugugcgacguccggacccucgagcccauccagcugccccugcucgacgugcgccgggugcuguggcacgcgacccaggaccaggaggaguccaugcgccuggucugcaugcucuacaccccgcugcggacgaacagccccggggacgaguccuucguggugagcggccgccugcucuccaagcccgccgccgacuucaacuucgucuaccugacgcccccgaucgagcggaccaucuaccgcaugguggaccugcccgugauccagccccggcucugcacccgcgcccgguggcccgccccggucuacgggcugcugguggaccccagccuccccuccaacccccaguggcagaacggccgcgugcacgucgacggcacccugcuggggaccaccccgaucagcggcuccugggugagcugcuucgcggccgaggccgccuacgaguuccgguccgggaccggcgaggaggucacguucacccucaucgagcaggacgggagcgccuacgugcccggcgaccgcgcggcgccccugggcuacccggacuucuccgggcagcuggagaucgaggugcagaccgagaccacgaagaccggcgacaagcucaaggucaccaccuucgagaugauccuggggccccggacgaacguggaccaggcccccuaccagggccgcgccuacgccagcgugaacgccaccgccagccugaaccucgucgacgggcgggugcgcgccgugccccgguccauccacagcuuccaggacgucaucccggaguacaacgacggccugcuggugccccucgccccgcccaucggccccuuccugcccuccgaggugcugcuccgcuuccggaccuacaugcgccagaucgacaccgcggacgccgccgccgaggccaucgacugcgcgcugccccaggaguucgucagcugguucgccuccaacgccuucacggugcagagcgaggcccugcuccugcgcuaccggaacacccugaccgggcagcuccuguucgagugcaagcuguacuccgagggcuacaucgcccugagcuacuccgggagcggcccccucaccuucccgacggacggguucuucgagguggucuccugggugccccgccuguaccagcuggcgagcgugggcucccucgccaccggccggacccugaagcaguga

SEQ ID NO: 10453 - RNA, 1626 nt, Artificial Sequence
  derived and/or modified sequence opt1 from capsid_protein__Norovirus__ACC96735
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuucccccgcggcagccugaccaccacgcagaucacgugcuucccccacgugaugugcgacguccggacccucgagcccauccagcugccccugcucgacgugcgccgggugcuguggcacgccacccaggaccaggaggaguccaugcgccuggucugcaugcucuacaccccgcugcggaccaacagccccggcgacgaguccuucguggugagcgggcgccugcucuccaagcccgcggccgacuucaacuucgucuaccugacgcccccgaucgagcggaccaucuaccgcaugguggaccugcccgugguccagccccggcucugcacccacgcccgcuggcccgccccgaucuacggccugcugguggaccccagccuccccuccaacccccaguggcagaacgggcgggugcacgucgacggcacccugcugggcaccaccccgaucagcggguccugggugagcugcuucgccgcggaggccgccuacgaguuccaguccggcacgggggaggucgccaccuucacccucaucgagcaggacggcagcgccuacgugcccggggaccgcgcggcgccccugggcuacccggacuucuccggccagcuggagaucgaggugcagaccgagacgaccaagaccggggacaagcucaaggucaccacguucgagaugauccugggccccgagaccaacgaggaccaggcccccuaccaggggcggguguucgccagcaucagcgccgccgccucccuggaccucguggacggccgcguccgggccgugccccgcagcaucuacggguuccaggacgugaucccggaguacaacgacggccugcuggucccccucgccccgcccaucggccccuuccugcccggggaggugcugcuccgguuccgcaccuacaugcgccagguggacacccaggacgcggccgccgaggccaucgacugcgcccugccccaggaguucgucuccugguucgcgagcaacgccuucacggugcaguccgaggcccugcuccugcgguaccgcaacacccugaccggccagcuccuguucgagugcaagcuguacagcgagggguacaucgcccuguccuacagcggccccgggccgcucaccuuccccuccaacggcuucuucgagguggucagcugggugccccggcuguaccagcuggccuccgugggcagccucgcgacggggcgcacccugaagcaguga

SEQ ID NO: 10454 - RNA, 1623 nt, Artificial Sequence
  derived and/or modified sequence opt1 from capsid_protein__Norovirus__ACF41177
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcuccuggggaccacgcagcucagccccgucaacaucugcuccuuccggggcgacgugacccacauccccggcacccgcaccuaccggaugaaccuggccagccagaacuggaacaacuacgacccgacggaggagauccccgcgccccuggggacccccgacuucgugggcaagauccaggggaugcucacccagaccacgaagggcgacggguccacccgcggccacaaggccaccgucagcaccggcagcguggacuucacgccgaagcugggguccgugcaguucgccaccgacaccgacaacgacuucgagaccggccagaacacgcgguucacccccgucggggugauccaggacggcagcuccacccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggccgcgcccucccagagcgacguggcccuccugcgguucgugaaccccgacaccggccgcguccuguucgagugcaagcuccacaaggccggguacgugaccguggcccacaccggccagcacgaccuggucaucccgcccaacggguacuuccgguucgacuccugggugaaccaguucuacacgcuggcgcccaugggcaacggcgccgggcgccgccgggccagcuga

SEQ ID NO: 10455 - RNA, 1623 nt, Artificial Sequence
  derived and/or modified sequence opt1 from capsid_protein__Norovirus__ACF41180
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgaccaagcgcgacggcagcacccgggggcacaaggccaccguguccacgggcagcgugcacuucaccccgaagcugggcagcguccaguucuccaccgacaccagcaacgacuucgagaucgggcagaacacgcgcuucacccccgugggcgugguccaggacggguccaccacccaccagaacgagccccagcagugggugcugcccaacuacagcggccgggacgggcacaacgugcaccucgccccggccgucgcccccacguuccccggcgagcagcugcuguucuuccgcuccaccaugcccggcugcagcggguacccgaacaugaaccucgacugccugcugccccaggagugggugcagcacuucuaccaggaguccgcccccgcgcagagcgacguggcccuccugcgguucgucaaccccgacaccggccgcgcccuguucgagugcaagcuccacaaguccggguacgugaccguggcccacaccggccagcacgaccuggucaucccgcccaacggguacuuccgguucgacagcugggugaaccaguucuacacgcuggcgcccaugggcaacggcgccgggcgccggcgcgcccucuga

SEQ ID NO: 10456 - RNA, 1623 nt, Artificial Sequence
  derived and/or modified sequence opt1 from capsid_protein__Norovirus__ACF41181
augaagauggccagcaacgacgccaaccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcuccuggggaccacgcagcucagccccgucaacaucugcaccuuccggggcgacgugacccacauccccggcacccgcacguaccggaugaaccuggccucccagaacuggaacaacuacgacccgaccgaggagauccccgcgccccuggggacccccgacuucgugggcaagauccaggggaugcucccgcagaccacgaagggcgacgggagcacccgcggccacaaggccaccgucuccaccggcagcguggacuucacgcccaagcuggggagcgugcaguucgccaccgacaccgacaacgacuucgagaccggccagaacacgcgguucacccccgucggggugauccaggacggcuccagcacccaccgcaacgagccccagcagugggugcugccggacuacuccgggcggaccgucuacaacgugcaccucgcccccgccguggcccccacguuccccggcgagcagcugcuguucuuccgcagcaccaugccgggcugcuccggguaccccaacauggaccucgacugccugcugccccaggaguggguccagcacuucuaccaggaggccgcgcccagccaguccgacguggcccuccugcgguucgugaacccggacaccggccgcguccuguucgagugcaagcuccacaaggccggguacgugaccguggcccacaccggccagcacgaccuggucaucccgcccaacggguacuuccgguucgacagcugggugaaccaguucuacacgcuggcgcccaugggcaacggcgccgggcgccgccgggcccucuga

SEQ ID NO: 10457 - RNA, 1623 nt, Artificial Sequence
  derived and/or modified sequence opt1 from capsid_protein__Norovirus__ACF41182
augaagauggccagcaacgacgccucccccagcgacggcuccaccgcgaaccuggugccggaggucaacaacgaggugauggcccucgagcccguggucggggccgccaucgccgcgcccgugaccggccagcagaacgugaucgaccccuggauccgcaacaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgccggcgacgacguguucaccguguccugccgcguccugacccggcccagcccggacuucgacuucaucuuccucgugccgcccaccguggagucccgcaccaagcccuucaccguccccauccugaccguggaggagaugacgaacagccgguuccccaucccccuggagaagcuguucaccggccccuccagcgcguucgugguccagccgcagaacgggcgcugcaccaccgacggcgugcuccuggggacgacccagcucucccccgucaacaucugcaccuuccggggcgacgugacccacauccccggcacgcgcaccuaccggaugaaccuggccagccagaacuggaacaacuacgacccgaccgaggagauccccgcgccccuggggacccccgacuucgugggcaagauccaggggaugcucacgcagaccaccaagggcgacggguccacccgcggccacaaggccacggucagcaccggcagcguggacuucaccccgaagcugggguccgugcaguucgccaccgacacggacaacgacuucgagaccggccagaacacccgguucacccccgucggggugauccaggacggcagcuccacgcaccgcaacgagccccagcagugggugcugcccgacuacagcgggcggaccgcccacaacguccaccucgccccggccguggcccccaccuuccccggcgagcagcugcuguucuuccgcuccaccaugcccggcugcagcggguacccgaacauggaccucgacugccugcugccccaggagugggugcagcacuucuaccaggaggccgcgcccucccagagcgacgucgcccuccugcgguucgugaaccccgacaccggccgcgugcuguucgagugcaagcuccacaaggccggguacgucacgguggcccacaccggccagcacgaccuggugaucccgcccaacggguacuuccgguucgacuccugggucaaccaguucuacacccuggcgcccaugggcaacggcgccgggcgccgccgggcccucuga

SEQ ID NO: 10458 - RNA, 1623 nt, Artificial Sequence
  derived and/or modified sequence opt1 from capsid_protein__Norovirus__ACF41183
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcgccuaccggaugaaccuggccagccagaacuggaacaacuacgacccgacggaggagauccccgcgccccuggggacccccgacuucgugggcaagauccaggggaugcucacccagaccacgaagggcgacggguccacccgcggccacaaggccaccgucagcaccggcagcguggacuucacgccgaagcugggguccgugcaguucgccaccgacaccgacaacgacuucgagaccggccagaacacgcgguucacccccgucggggugauccaggacggcagcuccacccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacuccugggugaaccaguucuacacgcuggcccccaugggcaacggcgccgggcgccgccgggcccucuga

SEQ ID NO: 10459 - RNA, 1623 nt, Artificial Sequence
  derived and/or modified sequence opt1 from capsid_protein__Norovirus__ACF41184
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccuggccguggaggagaugaccaacucccgguuccccaucccccuggagaagcuguucaccggccccagcuccgcccucgugguccagccgcagaacgggcgcugcaccacggacggcgugcugcucgggaccacccagcugagccccgucaacaucugcaccuuccggggcgacgugacgcacaucgccggcucccgcaacuacaccaugaaccuggcgagccucaacuggaacaacuacgaccccaccgaggagaucccggcgccccuggggacccccgacuucgugggcaagauccaggggguccugacgcagaccaccaagggcgacggguccacccggggccacaaggccacgguguacaccggcagcgcccccuucaccccgaagcucgggagcgugcaguucggcaccgacacggagaacgacuucgagacccaccagaacaccaaguucacccccgucggggugauccaggacggcuccacgacccaccgcaacgagccccagcagugggugcugcccagcuacuccgggcggaacguccacaacgugcaccuggccccggccguggcccccaccuuccccggcgagcagcuccuguucuuccgcagcaccaugcccggcugcuccggguacccgaacauggaccuggacugccuccugccccaggaguggguccagcacuucuaccaggaggccgcccccgcgcagagcgacguggcccugcuccgguucgugaaccccgacacgggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcaccgggcgccggcgcgcccuguga

SEQ ID NO: 10460 - RNA, 1623 nt, Artificial Sequence
  derived and/or modified sequence opt1 from capsid_protein__Norovirus__ACF41185
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguuccgcacggacaccgagaacgacuucgagacccaccagaacaccaaguucacgcccgucggggugauccaggacggcagcaccacccaccggaacgagccccagcagugggugcuccccuccuacagcgggcgcaacguccacaacgugcaccuggccccggccguggcgcccaccuuccccggcgagcagcuccucuucuuccgguccacgaugcccggcugcagcggguacccgaacauggaccuggacugccugcucccccaggaguggguccagcacuucuaccaggaggccgcccccgcccaguccgacguggcgcugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgcgcccuguga

SEQ ID NO: 10461 - RNA, 1623 nt, Artificial Sequence
  derived and/or modified sequence opt1 from capsid_protein__Norovirus__ACF41186
augaagauggccagcaacgacgccaaccccuccggcgggagcgcggccaaccuggugccggaggucaacaacgaggugauggcccucgagcccguggucggcgccgccaucgcggcccccguggccgggcagcagaacgugaucgaccccuggauccgcaacaacuucguccaggccccgggcggggaguucaccgugagcccccggaacgcgcccggcgagauccugugguccgcgccccugggcccggaccucaaccccuaccugucccaccuggcccgcauguacaacggguacgccggcggguucgaggugcaggucauccucgccggcaacgccuucaccgccgggaagaucaucuucgccgccgugccgcccaacuuccccacggagggccugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccgggcccagcuccgccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccaggacaccaaguucacgcccgucggggugauccaggacggcgggaccacccaccgcaacgagccccagcagugggugcuccccagcuacuccggccggaacguccagaacgugcaccuggccccggccguggcgcccaccuuccccggcgagcagcuccucuucuuccgcagcacgaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 10462 - RNA, 1623 nt, Artificial Sequence
  derived and/or modified sequence opt1 from capsid_protein__Norovirus__ACF41187
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccgcgggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccggaacgagccccagcagugggugcuccccagcuacuccgggcgcaacgucccgaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcgcccuguga

SEQ ID NO: 10463 - RNA, 1623 nt, Artificial Sequence
  derived and/or modified sequence opt1 from capsid_protein__Norovirus__ACF41188
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccgccuacaccggcagcgcccccuucaccccgaagcuggggagcgugcaguucuccacggacaccgagaacgacuucgagacccaccagaacaccaaguucgcccccgugggcgucauccaggacgggggcacgacccaccgcaacgagccccagcagugggugcuccccagcuacuccgggcggaacgugccgaacguccaccuggcgcccgccguggcccccaccuuccccggcgagcagcuccucuucuuccgcagcaccaugccgggcugcuccggguaccccaacauggaccuggacugccugcucccccaggagugggugcagcacuucuaccaggaggccgcgcccgcccagagcgacgucgcccugcugcgguucgugaacccggacacgggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcaccgggcgccggcgcgcgcuguga

SEQ ID NO: 10464 - RNA, 1623 nt, Artificial Sequence; identical to SEQ ID NO: 9441
  derived and/or modified sequence opt1 from capsid_protein__Norovirus__ACF41190

SEQ ID NO: 10465 - RNA, 1623 nt, Artificial Sequence
  derived and/or modified sequence opt1 from capsid_protein__Norovirus__ACF41191
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccgggcuucgacuucaucuuccucgugccgcccaccguggagagccgcaccaagcccuucacgguccccauccugaccguggaggagaugaccaacucccgguuccccaucccccuggagaagcuguucaccgggcccagcuccgccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggcgagcagcuccucuucuuccgcagcacgaugccggggugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 10466 - RNA, 1647 nt, Artificial Sequence
  derived and/or modified sequence opt1 from capsid_protein__Norovirus__ACF60293
augaagauggccagcaacgacgccacccccuccaacgacggcgcggccgggcuggugccggagaucaacaacgaggccauggcccucgaccccguggccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgagaaccucagcgccgcgcagaucaccaugugcccccacgugaucguggacguccgccagcuggagcccgugaaccugcccaugcccgacgugcggaacaacuucuuccacuacaaccagggcuccgacagcaagcuccgccuggucgccaugcuguacaccccgcuccgggccaacaacuccggcgacgacguguucacggugagcugccgcguccugacccggcccucccccgacuucagcuucaacuuccuggugcccccgaccguggaguccaagaccaagcccuucacgcuccccauccugaccaucagcgagauguccaacagccgcuuccccgucccgaucgacucccugcacaccagccccaccgagaacaucguggugcagugccagaacgggcgggucacgcucgacggcgagcugauggggaccacccagcugcuccccucccagaucugcgccuuccgcggcgugcugacccggagcacgucccgcgccagcgaccaggcggacaccgccacgccccggcuguucaacuacuacuggcacauccagcucgacaaccugaacggcaccccguacgaccccgccgaggacauccccgggccgcugggcacccccgacuuccgcgggaagguguucggcgucgccagccagcggaaccccgacuccaccacccgcgcccacgaggcgaagguggacaccacggccgggcgguucacccccaagcucggcagccuggagaucuccaccgagagcggcgacuucgaccagaaccagccgacccgcuucacgcccgucgggaucggcguggaccacgaggccgacuuccagcaguggucccugcccgacuacagcgggcaguucacccacaacaugaaccucgcccccgcgguggccccgaacuuccccggcgagcagcugcuguucuuccggucccagcuccccagcuccgggggccgcagcaacggcauccuggacugccgggucccccaggagugggugcagcacuucuaccaggaguccgccccggcccagacccagguggcccugguccgcuacgugaaccccgacaccgggcgcguccucuucgaggcgaagcugcacaagcugggcuucaugacgaucgccaagaacggggacagccccaucaccgugcccccgaacggcuacuuccgguucgaguccugggugaaccccuucuacacccucgcccccauggggaccggcaacggccgccggcgcauccaguga

SEQ ID NO: 10467 - RNA, 1647 nt, Artificial Sequence
  derived and/or modified sequence opt1 from capsid_protein__Norovirus__ACF60294
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgacuucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcccacgaggcgaagguggacaccacggccgggcgcuucacccccaagcucggcagccuggagaucuccaccgagagcggcgacuucgaccagaaccagccgacccgguucacgcccgucgggaucggcguggaccacgaggccgacuuccagcaguggucccugcccgacuacagcgggcaguucacccacaacaugaaccucgcccccgcgguggccccgaacuuccccggcgagcagcugcuguucuuccgcucccagcuccccagcuccgggggccggagcaacggcauccuggacugccuggucccccaggagugggugcagcacuucuaccaggaguccgccccggcccagacccagguggcccucguccgcuacgugaaccccgacaccgggcgcgugcuguucgaggcgaagcugcacaagcucggcuucaugacgaucgccaagaacggggacagccccaucaccgugcccccgaacggcuacuuccgguucgaguccugggugaaccccuucuacacccuggcccccauggggaccggcaacggccgccggcgcauccaguga

SEQ ID NO: 10468 - RNA, 1647 nt, Artificial Sequence
  derived and/or modified sequence opt1 from capsid_protein__Norovirus__ACF60295
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgaggucccccugaaccucgagcugggcccggagaucaaccccuaccuggcccaccucgcccggauguacaacggguacgccggcggguucgagguccagguggugcuggccggcaacgcguucaccgccgggaagaucaucuucgccgccaucccgcccaacuuccccaccgacaaccugagcgccgcgcagaucaccaugugcccccacgugaucguggacguccgccagcucgagcccgugaaccugcccaugccggacgugcggaacaacuucuuccacuacaaccagggcuccgacagccgccugcggcucgucgccaugcuguacacgccccugcgcgccaacaacuccggcgacgacguguucaccgugagcugccggguccucacccgccccucccccgacuucagcuucaacuuccuggugccgcccaccguggaguccaagacgaagcccuucacccugcccauccucaccaucagcgagauguccaacagccgguucccgguccccaucgacucccugcacaccagccccacggagaacaucguggugcagugccagaacgggcgcgucacccuggacggcgagcucauggggaccacccagcugcugcccucccagaucugcgccuuccggggcgugcucacgcgcagcaccucccgggccagcgaccaggcggacaccgccaccccgcgccuguucaacuacuacuggcacauccagcuggacaaccucaacggcacgcccuacgaccccgccgaggacaucccggggccccugggcacccccgacuuccgggggaagguguucggcgucgccagccagcgcaaccccgacuccaccacccgggcccacgaggcgaagguggacacgaccgccgggcgcuucaccccgaagcugggcagccucgagaucuccaccgagagcgacgacuucgaccagaaccagcccacgcgguucacccccgucggcaucgggguggaccacgaggccgacuuccagcaguggucccugcccgacuacagcggccaguucacccacaacaugaaccuggccccggcgguggcccccaacuuccccggggagcagcuccuguucuuccgcucccagcugcccagcuccggcgggcggagcaacggcauccucgacugccuggucccgcaggagugggugcagcacuucuaccaggaguccgcccccgcccagacccagguggcccugguccgcuacgugaaccccgacacgggccgcguccucuucgaggcgaagcugcacaagcugggguucaugaccaucgccaagaacggcgacagccccaucaccgugccgcccaacggguacuuccgguucgaguccugggugaaccccuucuacacccucgcccccaugggcacggggaacggccgccggcgcauccaguga

SEQ ID NO: 10469 - RNA, 1647 nt, Artificial Sequence
  derived and/or modified sequence opt1 from capsid_protein__Norovirus__ACF60296
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgacuucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcccacgaggcgaagguggacaccacggccgggcgcuucacccccaagcucggcagccuggagaucuccaccgagagcgacgacuucgaccagaaccagccgacccgguucacgcccgucggcaucgggguggaccacgaggccgacuuccagcaguggucccugcccgacuacagcggccaguucacccacaacaugaaccucgcccccgcgguggccccgaacuuccccggggagcagcugcuguucuuccgcucccagcuccccagcuccggcgggcggagcaacggcauccuggacugccuggucccccaggagugggugcagcacuucuaccaggaguccgccccggcccagacccagguggcccucguccgcuacgugaaccccgacaccggccgcgugcuguucgaggcgaagcugcacaagcucggguucaugacgaucgccaagaacggcgacagccccaucaccgugcccccgaacggguacuuccgguucgaguccugggugaaccccuucuacacccuggcccccaugggcaccgggaacggccgccggcgcauccaguga

SEQ ID NO: 10470 - RNA, 1647 nt, Artificial Sequence
  derived and/or modified sequence opt1 from capsid_protein__Norovirus__ACF60297
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccagguggugcuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgacuucagcuucaacuuccuggugcccccgaccguggaguccaagaccaagcccuucacgcuccccauccugaccaucagcgagauguccaacagccgguuccccgucccgaucgacucccuguacaccagccccaccgagaacaucguggugcagugccagaacgggcgcgucacgcucgacggcgagcugguggggaccacccagcugcuccccucccagaucugcgccuuccggggcgugcugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacuccaccacccgggcccacgaggcgaaggucgacaccacggccgggcgcuucacccccaagcucggcagccuggagaucuccaccgagagcggcgacuucgaccagaaccagccgacccgguucacgcccguggggaucggcguggaccacgaggccgacuuccagcaguggucccugcccgacuacagcgggcaguucacccacaacaugaaccucgcccccgcggucgccccgaacuuccccggcgagcagcugcuguucuuccgcucccagcuccccagcuccgggggccggagcaacggcauccuggacugccuggugccccaggagugggugcagcacuucuaccaggaguccgccccggcccagacccaggucgcccucgugcgcuacgugaaccccgacaccgggcgcguccuguucgaggcgaagcugcacaagcucggcuucaugacgaucgccaagaacggggacagccccaucaccgugcccccgaacggcuacuuccgguucgaguccugggugaaccccuucuacacccuggcccccauggggaccggcaacggccgccggcgcauccaguga

SEQ ID NO: 10471 - RNA, 1626 nt, Artificial Sequence
  derived and/or modified sequence opt1 from capsid_protein__Norovirus__ACF72688
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuucagcaagggcucccugaccaccgcccagaucacgugcuucccccacgugaugugcgacguccgcacccucgagcccauccagcugccccugcucgacgugcggcgcgugcuguggcacgcgacccaggaccaggaggagagcaugcggcuggucugcaugcucuacacgccccugcgcaccaacuccccgggcgacgagagcuucgugguguccgggcggcugcucagcaagcccgcccccgacuucaacuucgucuaccugacgcccccgaucgagcgcaccaucuaccggaugguggaccugccccuccugcagccccgccugugcacccacgcccgguggcccgccccgguguacggccuccuggucgaccccucccugcccagcaacccccaguggcagaacgggcgcgugcacguggacggcacccuccugggcaccaccccggucuccgggagcuggguguccugcuucgccgcggaggccgccuacgaguuccagagcggcaucggggaggucgugaccuucacgaugaucgagcaggacggcuccgccuacgugcccggggaccgggccgcgccccugggcuacccggacuucagcggccagcucgagaucgagguccagaccgagaccaccaagacgggggacaagcugaaggugaccaccuucgagaugauccugggccccaccacgaacguggaccaggcccccuaccaggggcgcgccuacgccagccucaccgcgauggccucccuggaccuggucgacggccgggugcgcgccgugccccggagcaucuacuccuuccaggacgagcucccggaguacaacgacgggcugcuggucccccucgccccgccccugggccccuuccugcccggcgaggugcuccugcgcuuccggaccuacaugcgccagcuggacaccgccgacgcggccgcccagcccaucgacugcgcccucccccaggaguucaucagcugguucgccuccaacaacuucacggugcagagcgacgcgcugcugguccgguaccgcaacacccugaccgggcagcuccuguucgaggccaagcuguacuccgagggcuacaucgccgugagcuacuccgggagcggcccgcucaccuuccccacggacggguucuucgagguggucuccugggugccccgccuguuccagcuggccagcgugggcucccucgccaccggccggacccugaagcaguga

SEQ ID NO: 10472 - RNA, 1623 nt, Artificial Sequence
  derived and/or modified sequence opt1 from capsid_protein__Norovirus__ACH42093
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacaccaaguucacccccgugggcgugguccaggacggguccaccacgcaccagaacgagccccagcagugggugcugcccgacuacagcggccgggacucccacaacgugcaccucgccccggccgucgcccccaccuuccccggggagcagcugcuguucuuccgcagcaccaugcccggcugcuccggcuacccgaacaugaaccucgacugccugcugccccaggagugggugcagcacuucuaccaggagagcgcccccgcgcaguccgacguggcccuccugcgguucgucaaccccgacaccgggcgcgugcuguucgagugcaagcuccacaagagcggcuacgugaccgucgcccacacggggcagcacgaccuggugaucccgcccaacggcuacuuccgguucgacuccugggugaaccaguucuacacccuggcccccauggggaacggcgcgggccgccggcgcgcccucuga

SEQ ID NO: 10473 - RNA, 1623 nt, Artificial Sequence; identical to SEQ ID NO: 9307
  derived and/or modified sequence opt1 from capsid_protein__Norovirus__ACH42094

SEQ ID NO: 10474 - RNA, 1623 nt, Artificial Sequence; identical to SEQ ID NO: 9307
  derived and/or modified sequence opt1 from capsid_protein__Norovirus__ACH42096

SEQ ID NO: 10475 - RNA, 1623 nt, Artificial Sequence; identical to SEQ ID NO: 9307
  derived and/or modified sequence opt1 from capsid_protein__Norovirus__ACH42097

SEQ ID NO: 10476 - RNA, 1623 nt, Artificial Sequence; identical to SEQ ID NO: 9307
  derived and/or modified sequence opt1 from capsid_protein__Norovirus__ACH42098

SEQ ID NO: 10477 - RNA, 1623 nt, Artificial Sequence
  derived and/or modified sequence opt1 from capsid_protein__Norovirus__ACJ66263
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcgcggggcgccggcgcgcccuguga

SEQ ID NO: 10478 - RNA, 1623 nt, Artificial Sequence
  derived and/or modified sequence opt1 from capsid_protein__Norovirus__ACJ66265
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccaugagcccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagcgccucuucaccggcccgagcuccgccuucgugguccagccccagaacgggcggugcacgaccgacggcgugcugcuggggaccacccagcucagccccgucaacaucugcacguuccgcggcgacgugacccacaucgccggcacccaggaguacaccaugaaccuggccucccagaacuggaacaacuacgacccgacggaggagauccccgcgccccuggggacccccgacuucgugggcaagauccaggggguccucacccagaccacgcggcgcgacggcagcacccgggggcacaaggccaccgugagcaccggcuccgugcacuucacgccgaagcugggccgcauccaguucagcaccgacaccuccaacgacuucgagaccgggcagaacacgcgguucacccccgucggcguggugcaggacgggggcaccacccaccagaacgagccccagcaguggguccugcccaacuacagcgggcgcgacggccacaacgugcaccucgccccggccguggcccccuccuuccccggcgagcagcugcuguucuuccggagcacgaugcccgggugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccaugggcaacgggacgggccgccggcgcgcccucuga

SEQ ID NO: 10479 - RNA, 1623 nt, Artificial Sequence
  derived and/or modified sequence opt1 from capsid_protein__Norovirus__ACJ66267
augaagauggccagcaacgacgccaaccccuccgacggcagcaccgcgaaccuggugccggaggucaacuccgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagcgccucuacacgggcccgagcuccgccuucgugguccagccccagaacgggcggugcaccaccgacggcgugcugcuggggaccacgcagcucagcgccgucaacaucugcaccuuccgcggcgacgugacccacaucgccggcucccggaacuacaccaugaaccuggccagccagaacuggaacaacuacgaccccacggaggagaucccggcgccccuggggacccccgacuucgugggcaagauccaggggaugcucacccagaccacgcgcuccgacggcagcacccgggggcacaaggccaccguccugaccggcagcgccgacuucgcccccaagcugggccgcgugcaguucgccacggacaccgacaacgacuucgaguccgggcagaacaccaaguucaccccggugggcgucauccaggacgggagcacgacccaccggaacgagccccagcagugggugcuccccuccuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcgcggggcgccggcgcgcccuguga

SEQ ID NO: 10480 - RNA, 1623 nt, Artificial Sequence
  derived and/or modified sequence opt1 from capsid_protein__Norovirus__ACJ66269
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgccaacaucugcacguuccgcggcgacgucacccacaucgccggcacccaggaguacaccaugaaccuggccagccagaacuggaacaacuacgacccgacggaggagauccccgcgccccuggggacccccgacuucgugggcaagauccagggggugcucacccagaccacgcggcgcgacggcuccacccgggggcacaaggccaccgucagcaccggcagcgugcacuucacgccgaagcugggccgcauccaguucuccaccgacaccagcaacgacuucgagaccgggcagaacacgcgguucacccccgugggcgucgugcaggacgggggcaccacccaccagaacgagccccagcagugggugcugcccaacuacuccgggcgcgacggccacaacguccaccucgccccggccguggcccccagcuuccccggcgagcagcugcuguucuuccgguccacgaugcccgggugcagcggcuacccgaacaugaaccucgacugccugcugccccaggagugggugcagcacuucuaccaggaggcggcccccgcccaguccgacgucgcccuccugcgcuucgugaaccccgacaccgggcgggugcuguucgagugcaagcuccacaagagcggcuacgucaccguggcgcacaccgggcagcacgaccuggugaucccgcccaacggcuacuuccgcuucgacuccugggucaaccaguucuacacccuggcccccaugggcaacgggacgggccgccggcgcgcccucuga

SEQ ID NO: 10481 - RNA, 1623 nt, Artificial Sequence
  derived and/or modified sequence opt1 from capsid_protein__Norovirus__ACJ66271
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucuccagcgucaacaucugcacguuccgcggcgacgugacccacaucgccggcacccaggaguacaccaugaaccuggccucccagaacuggaacaacuacgaccccacggaggagaucccggcgccccuggggacccccgacuucgugggcaagauccaggggguccucacccagaccacgcggcgcgacggcagcacccgggggcacaaggccaccgugagcaccggcuccgugcacuucacgcccaagcugggccgcauccaguucagcaccgacaccuccaacgacuucgagaccgggcagaacacgcgguucaccccggucggcguggugcaggacgggagcaccacccaccagaacgagccccagcaguggguccugcccaacuacuccggccgcgacgggcacaacgugcaccucgcccccgccguggccccgagcuuccccggcgagcagcugcuguucuuccgguccacgaugcccggcugcagcggguaccccaacaugaaccucgacugccugcugccgcaggaguggguccagcacuucuaccaggaggccgcgcccgcccaguccgacguggcccuccugcgcuucgugaaccccgacaccggccggguccuguucgagugcaagcuccacaagagcggguacgugaccguggcccacaccggccagcacgaccuggucaucccgcccaacggguacuuccgcuucgacuccugggugaaccaguucuacacccuggcgcccaugggcaacggcacggggcgccggcgcgcccucuga

SEQ ID NO: 10482 - RNA, 1623 nt, Artificial Sequence
  derived and/or modified sequence opt1 from capsid_protein__Norovirus__ACJ66273
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccuccuacagcgggcgggacucccacaacgugcaccucgccccggccguggcccccagcuuccccggcgagcagcugcuguucuuccgcuccacgaugcccgggugcagcggcuacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacggggccggccgccgccgggcccucuga

SEQ ID NO: 10483 - RNA, 1623 nt, Artificial Sequence
  derived and/or modified sequence opt1 from capsid_protein__Norovirus__ACJ66275
augaagauggccagcuccgacgccagccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccugagccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcggcgacgggagcacccggggccacaaggccaccgucuacaccggcagcgccgacuucgcccccaagcuggggcgcgugcaguucgccacggacaccgacaacgacuucgaguccaaccagaacaccaaguucaccccggugggcgucauccaggacgggaacacgacccaccggaacgagccccagcagugggugcugcccggcuacagcgggcgcgacggccacaacgugcaccucgcgcccgccgucgccccgaccuaccccggcgagcagcugcuguucuuccgguccaccaugcccgggugcagcggcuaccccaacauggaccucgacugccugcugccgcaggagugggugcagcacuucuaccaggaggccgcgcccgcccaguccgagguggcccuccugcgcuucgucaaccccgacacggggcgggugcuguucgagugcaagcuccacaagagcggcuacgugaccgucgcccacaccgggcagcacgaccuggugaucccgcccaacggcuacuuccgcuucgacuccugggugaaccaguucuacacccuggcccccaugggcaacggggcgggccgccggcgcgcccucuga

SEQ ID NO: 10484 - RNA, 1623 nt, Artificial Sequence
  derived and/or modified sequence opt1 from capsid_protein__Norovirus__ACJ66279
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaacuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacaccgggcagcacgaccuggugaucccgcccaacggcuacuuccgcuucgacuccugggugaaccaguucuacacgcuggcccccauggggaacggcgcgggccggcgccgcgcccucuga

SEQ ID NO: 10485 - RNA, 1623 nt, Artificial Sequence
  derived and/or modified sequence opt1 from capsid_protein__Norovirus__ACJ66281
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggagaagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10486 - RNA, 1623 nt, Artificial Sequence
  derived and/or modified sequence opt1 from capsid_protein__Norovirus__ACJ66283
augaagauggccagcaacgacgccaaccccuccgacggcagcgcggccaaccuggugcucgaggucaacaacgaggugauggcccuggagccgguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccucggccccgaccugaacccguaccugucccaccucgcccgcauguacaacggcuacgccgggggcuucgaggugcaggucauccuggccgggaacgccuucaccgccggcaagaucaucuucgccgccgugccgcccaacuuccccacggaggggcugagccccucccaggugaccauguucccccacaucaucgucgacgugcggcagcucgagcccgugcugaucccccugccggacguccgcaacaacuucuaccacuacaaccagagcaacgacuccaccaucaagcucaucgccaugcuguacacgccccugcgggcgaacaacgccggcgaggacguguucaccgugagcugccgcguccucacccggcccucccccgacuucgacuucaucuuccuggugccgcccaccguggagagccgcaccaagcccuucacgguccccauccugaccguggaggagaugaccaacucccgguucccgaucccccucgagaagcuguucaccggccccagcggggccuucgugguccagccccagaacggccgcugcacgaccgacggggugcugcucggcaccacccagcuguccccggucaacaucugcacguuccggggcgacgugacccacaucgccgggagccgcaacuacaccaugaaccuggccucccucaacuggaacaacuacgaccccaccgaggagauccccgcgccgcugggcacgcccgacuucguggggaagauccagggcguccugacccagaccaccaagggggacggcagcacgcggggccacaaggccaccguguacaccggguccgcccccuucacccccaagcucggcagcgugcaguucagcacggacaccgagaacgacuucgagacccaccagaacaccaaguucacgccggucggggugauccaggacggcuccaccacccaccgcaacgagccccagcagugggugcugcccagcuacuccgggcggaacguccacaacgugcaccuggcccccgccguggcgccgaccuuccccggcgagcagcuccuguucuuccgcagcacgaugcccggcugcuccggguaccccaacauggaccuggacugccuccugccgcaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcacggggcgccggcgcgcccuguga

SEQ ID NO: 10487 - RNA, 1623 nt, Artificial Sequence
  derived and/or modified sequence opt1 from capsid_protein__Norovirus__ACJ66285
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgacccccgcauccggaacaacuucguccaggcccccgggggcgaguucaccgugagcccccgcaacgcccccggggagauccugugguccgcgccccugggcccggaccucaaccccuaccugagccaccuggcccggauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcgccagcuggagcccgugcucaucccgcugcccgacguccggaacaacuucuaccacuacaaccagagcaacgaccccaccaucaagcugaucgccaugcucuacacgccccugcgcgccaacaacgcgggggacgacguguucaccguguccugcuggguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggagcgacgggagcacccggggccacaaggccaccguguccaccgggagcgugcacuucacgccgaagcugggccgcauccaguucuccaccgacaccagcaacgacuucgagaccggccagaacacgcgguucacccccgucgggguggugcaggacggcuccaccacccaccagaacgagccccagcaguggguccugcccaacuacagcgggcgcgacucccacaacgugcaccucgccccggccguggcccccagcuuccccggcgagcagcugcuguucuuccgguccacgaugcccgggugcagcggcuacccgaacaugaaccucgacugccugcugccccaggaguggguccagcacuucuaccaggaggccgcgcccgcccaguccgacguggcccuccugcgcuucgugaaccccgacaccggccggguccuguucgagugcaagcuccacaagagcggguacgugaccguggcccacaccggccagcacgaccuggucaucccgcccaacggguacuuccgcuucgacuccugggugaaccaguucuacacccuggcgcccaugggcaacgggacgggccggcgccgcgcccucuga

SEQ ID NO: 10488 - RNA, 1623 nt, Artificial Sequence; identical to SEQ ID NO: 9292
  derived and/or modified sequence opt1 from capsid_protein__Norovirus__ACJ66286

SEQ ID NO: 10489 - RNA, 1626 nt, Artificial Sequence
  derived and/or modified sequence opt1 from capsid_protein__Norovirus__ACJ72216
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccgaucuacggccugcucgucgaccccagccugcccuccaacccccaguggcagaacgggcgcgugcacguggacggcacccugcucggcaccaccccgaucagcggguccugggucagcugcuucgcggccgaggccgccuacgaguuccaguccggcaccggggagguggucacguucagcaugaucgagcaggacggcuccgccuacgugcccggggaccgggcggcgccccugggcuacccggacuacagcggccagcuggagaucgaggugcagaccgagaccaccaaggccggggacaagcucaaggucacgaccuucgagaugauccugggccccaccaccaacguggaccaggcccccuaccaggggaaggccuacgccagccuguccacgaccgccagccucgaccugguggacggccgcguccgggccgugccccgcuccguguacagcuuccaggacguccugccggaguacaacgacgggcuccuggugccccuggccccgccccucggccccuaccugcccggcgaggugcugcuccgguuccgcaccuacaugcggcagcuggacaccgcggacgccgccgcccagcccaucgacugcgcccugccccaggaguucaucuccugguucgcgagcuccaacuucacgguccagagcgaggcccuccuggugcgcuaccggaacacccugaccgggcagcuccuguucgaggccaagcuguacuccgagggcuacaucgccgugagcuacuccgggagcggcccgcugaccuuccccacggacggguucuucgaggucguguccugggugccccgccucuuccagcuggccagcgucggcucccuggcgaccggccgcacccucaagcaguga

SEQ ID NO: 10490 - RNA, 1620 nt, Artificial Sequence
  derived and/or modified sequence opt1 from capsid_protein__Norovirus__ACL27297
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgccgacguguucaccgugagccgccggguccugacccgccccuccccggacuucgacuucaucuucagcgugccgcccaccguggagucccggacgaagcccuucaccguccccauccucaccguggaggagaugagcaacucccgcuuccccaucccccuggagaagcuguacaccggccccagcuccgccuucgugguccagccgcagaacgggcggugcacgaccgacggcgugcuccuggggaccacccagcugagcgccgucaacaucugcacguuccgcggcgacgugacccacaucgccggcucccacgacuacaccaugaaccucgcgagccagaacuggaacaacuacgaccccaccgaggagauccccgccccgcuggggacgcccgacuucgugggcaagauccaggggaugcugacccagaccacccgggaggacggcagcacgcgcgcccacaaggccaccgucuccaccgggagcgugcacuucacccccaagcucggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcggaccggccacaacguccaccuggcccccgcgguggcccccaccuucccgggggagcagcuccuguucuuccgcuccacgaugcccggcugcagcggcuaccccaacaugaaccuggacugccuccugccccaggagugggugcagcacuucuaccaggaggccgccccggcgcaguccgacgucgcccugcuccgguucgugaaccccgacaccgggcgcgugcuguucgagugcaagcugcacaagagcggcuacgucaccguggcccacaccgggccccacgaccucgugaucccgcccaacggcuacuuccgguucgacuccugggucaaccaguucuacacccuggcccccauggggaacggcgccggccgccggcgcgcgcuguga

SEQ ID NO: 10491 - RNA, 1623 nt, Artificial Sequence
  derived and/or modified sequence opt1 from capsid_protein__Norovirus__ACL27298
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggggccuucgugguccagccccagaacggccgcugcaccaccgacggggugcuccugggcaccacgcagcucucccccgucaacaucugcaccuuccggggcgacgugacccacaucgccgggacccacgacuacacgaugaaccuggccagccagaacuggaacaacuacgacccgaccgaggagauccccgcgccccugggcacccccgacuucguggggaagauccagggcguccucacccagacgacccgcggggacggcuccacccggggccacaaggccaccgugagcacgggguccgugcacuucaccccgaagcugggcagcguccaguucaccaccgacacgaacaacgacuucgagaccgggcagaacaccaaguucacccccgugggcgugguccaggacgggaacagcacgcaccagaacgagccccagcagugggugcugcccaacuacuccggccgcaccggccacaacgugcaccucgccccggccgucgcccccaccuuccccggggagcagcugcuguucuuccggagcaccaugcccggcugcuccggguacccgaacaugaaccucgacugccugcugccccaggagugggugcagcacuucuaccaggaggccgcgcccgcccagagcgacguggcccuccugcgcuucgucaaccccgacaccggccgggugcuguucgagugcaagcuccacaaguccggguacgugacggucgcccacaccggccagcacgaccuggugaucccgcccaacggcuacuuccgcuucgacagcugggugaaccaguucuacacccuggcgcccauggggaacggcgccgggcggcgccgggcccucuga

SEQ ID NO: 10492 - RNA, 1623 nt, Artificial Sequence
  derived and/or modified sequence opt1 from capsid_protein__Norovirus__ACL27299
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaugaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggagcaacuacgaccccacggaggagaucccggcgccccuggggacccccgacuucgugggcaagauccaggggaugcucacccagaccacgcgccgggacggcuccacccgcgggcacaaggccaccguccugaccggcagcgccgacuucgcccccaagcugggccgggugcaguucgccacggacaccgacaacgacuucgagagcggggagaacaccaaguucaccccggugggcgucauccaggacggguccacgacccaccgcaacgagccccagcagugggugcuccccaacuacagcggccggaccgggcacaacgugcaccuggcgcccgccgucgccccgaccuaccccggcgagcagcuccucuucuuccgcuccacgaugcccggcugcagcggguaccccaacauggaccuggacugccugcucccgcaggagugggugcggcacuucuaccaggaggccgcgcccgcccaguccgacguggcccugcugcgcuucgucaaccccgacaccggccgcgugcuguucgagugcaagcugcacaagagcggguacgugaccgucgcccacaccggccagcacgaccuggugaucccgcccaacggguacuuccgguucgacuccugggugaaccaguucuacacccucgcccccaugggcaacggcgcggggcgccggcgcgcccuguga

SEQ ID NO: 10493 - RNA, 1623 nt, Artificial Sequence
  derived and/or modified sequence opt1 from capsid_protein__Norovirus__ACL27300
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggagcaacuacgaccccacggaggagaucccggcgccccuggggacccccgacuucgugggcaagauccaggggaugcucacccagaccacgcgccgggacggcuccacccgcgggcacaaggccaccguccugaccggcagcgccgacuucgcccccaagcugggccgggugcaguucgccacggacaccgacaacgacuucgagagcggggagaacaccaaguucaccccggugggcgucauccaggacggguccacgacccaccgcaacgagccccagcagugggugcuccccaacuacagcggccggaccgggcacaacgugcaccuggcgcccgccgucgccccgaccuaccccggcgagcagcuccucuucuuccgcuccacgaugcccggcugcagcggguaccccaacauggaccuggacugccugcucccgcaggagugggugcggcacuucuaccaggaggccgcgcccgcccaguccgacguggcccugcugcgcuucgucaaccccgacaccggccgcgugcuguucgagugcaagcugcacaagagcggguacgugaccgucgcccacaccggccagcacgaccuggugaucccgcccaacggguacuuccgguucgacuccugggugaaccaguucuacacccucgcccccaugggcaacggcgcggggcgccggcgcgcccuguga

SEQ ID NO: 10494 - RNA, 1623 nt, Artificial Sequence
  derived and/or modified sequence opt1 from capsid_protein__Norovirus__ACL31312
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcgccgggacggcuccacccgcgggcacaaggccaccgugagcaccggcagcgugcacuucacgccgaagcugggccggauccaguucuccaccgacaccagcaacgacuucgagaccgggcagaacacgcgcuucacccccgucggcguggugcaggacggguccaccacccaccagaacgagccccagcaguggguccugcccgacuacagcggccgggacucccacaacgugcaccucgccccggccguggcccccagcuuccccggggagcagcugcuguucuuccgcuccacgaugcccggcugcagcggcuacccgaacaugaaccucgacugccugcugccccaggaguggguccagcacuucuaccaggaggccgcgcccgcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgggcccucuga

SEQ ID NO: 10495 - RNA, 1623 nt, Artificial Sequence
  derived and/or modified sequence opt1 from capsid_protein__Norovirus__ACL31313
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccguguccacgggcagcgugcacuucaccccgaagcuggggagcguccaguucuccaccgacaccagcaacgacuucgagacgggccagaacacccgcuucacccccgugggggugguccaggacggcuccaccacgcaccagaacgagccccagcagugggugcugcccgccuacagcgggcgggacaaccacaacgugcaccucgccccggccgucgcccccaccuuccccggcgagcagcugcuguucuuccgcuccaccaugcccggcugcagcggguacccgaacaugaaccucgacugccugcugccccaggagugggugcagcacuucuaccaggaguccgcgcccgcccagagcgacguggcccuccugcgguucgucaaccccgacaccggccgcgugcuguucgagugcaagcuccacaaguccggguacgugaccgucgcccacacgggccagcacgaccuggugaucccgcccaacggguacuuccgguucgacagcugggugaaccaguucuacacccuggcgcccaugggcaacggcgccgggcgccggcgcgcccucuga

SEQ ID NO: 10496 - RNA, 1623 nt, Artificial Sequence
  derived and/or modified sequence opt1 from capsid_protein__Norovirus__ACL31316
augaagauggccagcuccgacgccacccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgccuucgugguccagccccagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggcaagauccaggggaugccgacccagacgacccgcggcgacggguccacccggggccacaaggccaccgucagcacgggcagcgugcacuucacccccaagcucggguccgugcaguucagcaccgacaccuccaacgacuucgagacgggccagaacacccgcuucacccccgucgggguggugcaggacggcagcaccacgcaccagaacgagccccagcaguggguccugccgaacuacuccgggcgggacagccacaacgugcaccuggcccccgccguggcccccaccuuccccggcgagcagcuccuguucuuccgcuccaccaugccgggcugcagcggguaccccaacaugaaccuggacugccuccugccccaggaguggguccagcacuucuaccaggaguccgcccccgcgcagagcgacguggcccugcuccgguucgugaacccggacaccggccgcguccuguucgagugcaagcugcacaaguccggguacgugaccguggcccacacgggccagcacgaccucgucaucccgcccaacggguacuuccgguucgacagcugggugaaccaguucuacacccuggcccccaugggcaacggcgcggggcgccggcgcgcccuguga

SEQ ID NO: 10497 - RNA, 1623 nt, Artificial Sequence
  derived and/or modified sequence opt1 from capsid_protein__Norovirus__ACL31317
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcggcgcgacggcuccacccgggggcacaaggccaccgugagcaccggcagcgugcacuucacgccgaagcugggccgcauccaguucuccaccgacaccagcaacgacuucgagaccgggcagaacacgcgguucacccccgucggcguggugcaggacggguccaccacccaccagaacgagccccagcaguggguccugcccgacuacagcggccgcgacgggcacaacgugcaccucgccccggccguggcccccuccuuccccggcgagcagcugcuguucuuccggagcacgaugcccggcugcuccggguacccgaacaugaaccucgacugccugcugccccaggaguggguccagcacuucuaccaggaggccgcgcccgcccagagcgacguggcccuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccaguucuacacccuggcgcccaugggcaacggcacggggcgccggcgcgcccucuga

SEQ ID NO: 10498 - RNA, 1623 nt, Artificial Sequence
  derived and/or modified sequence opt1 from capsid_protein__Norovirus__ACL31319
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagguccuccuggccgggaacgccuucacggcgggcaagaucaucuucgccgccgugccgcccaacuucccgaccgaggggcugucccccagccaggugaccauguucccccacaucaucgucgacgugcggcagcucgagcccgugcugaucccgcugcccgacguccgcaacaacuucuaccacuacaaccaguccaacgaccccaccaucaagcucaucgccaugcuguacacgccccugcgggccaacaacgcgggcgacgacguguucaccgugagcugccgcguccucacccggccgucccccgacuucgacuucaucuuccuggugccgcccaccguggagagccgcacgaagcccuucuccguccccauccugaccguggaggagaugaccaacagccgguuccccaucccccucgagcgccuguucaccggcccguccagcgccuucgugguccagccccagaacgggcggugcacgaccgacggcgugcugcucgggaccacccagcugucccccgucaacaucugcacguuccgcggcgacgugacccacaucgccggcacccaggaguacaccaugaaccuggccagccagaacuggaacaacuacgacccgacggaggagauccccgcgccccucgggacccccgacuucgugggcaagauccaggggguccugacccagaccacgcggcgcgacggcuccacccgggggcacaaggccaccgugagcaccggcagcgugcacuucacgccgaagcugggccgcauccaguucuccaccgacaccagcaacgacuucgagaccgggcagaacacgcgguucacccccgucggcguggugcaggacgggggcaccacccaccagaacgagccccagcaguggguccuccccgacuacuccgggcgcgacagccacaacgugcaccuggccccggccguggcccccuccuuccccggcgagcagcuccuguucuuccggagcacgaugcccggcugcuccggguacccgaacaugaaccuggacugccugcucccccaggaguggguccagcacuucuaccaggaggccgcgcccgcccagagcgacguggcccugcugcgcuucgugaaccccgacaccggccggguccucuucgagugcaagcugcacaaguccggguacgugaccguggcccacaccggccagcacgaccuggucaucccgcccaacggguacuuccgcuucgacagcugggugaaccaguucuacacccucgcgcccaugggcaacggcacggggcgccggcgcgcccuguga

SEQ ID NO: 10499 - RNA, 1623 nt, Artificial Sequence
  derived and/or modified sequence opt1 from capsid_protein__Norovirus__ACL31320
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcggcgcgacggcuccacccgggggcacaaggccaccgugagcaccggcagcgugaacuucacgccgaagcugggccgcauccaguucuccaccgacaccagcaacgacuucgagaccgggcagaacacgcgguucacccccgucggcguggugcaggacggguccaccacccaccagaacgagccccagcaguggguccugcccgacuacagcggccgcgacucccacaacgugcaccucgccccggccguggcccccagcuuccccggggagcagcugcuguucuuccgguccacgaugcccggcugcagcggcuacccgaacaugaaccucgacugccugcugccccaggaguggguccagcacuucuaccaggaggccgcgcccgcccaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcgcccauggggaacggcacgggccgccggcgcgcccucuga

SEQ ID NO: 10500 - RNA, 1623 nt, Artificial Sequence
  derived and/or modified sequence opt1 from capsid_protein__Norovirus__ACL31322
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcgccgggacggcuccacccgcgggcacaaggccaccgugagcaccggcagcgugcacuucacgccgaagcugggccggauccaguucuccaccgacaccagcaacgacuucgagaccgggcagaacacgcgcuucacccccgucggcguggugcaggacggguccaccacccaccagaacgagccccagcagugggcccugcccgacuacagcggccgggacucccacaacguccaccucgccccggccguggcccccagcuuccccggggagcagcugcuguucuuccgcuccacgaugcccggcugcagcggcuacccgaacaugaaccucgacugccugcugccccaggagugggugcagcacuucuaccaggaggcggcccccgcccaguccgacgucgcccuccugcgguucgugaaccccgacaccgggcgcgugcuguucgagugcaagcuccacaagagcggcuacgucaccguggcgcacaccgggcagcacgaccuggugaucccgcccaacggcuacuuccgguucgacuccugggucaaccaguucuacacccuggcccccauggggaacggcacgggccgccgccgggcccucuga

SEQ ID NO: 10501 - RNA, 1623 nt, Artificial Sequence
  derived and/or modified sequence opt1 from capsid_protein__Norovirus__ACL31324
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagcgccucuucaccggccccagcuccgccuucgugguccagccgcagaacgggcggugcacgaccgacggcgugcugcuggggaccacccagcucagccccgucaacaucugcacguuccgcggcgacgugacccacaucgccggcacccaggaguacaccaugaaccuggccucccagaacuggaacaacuacgaccccacggaggagaucccggcgccccuggggacccccgacuucgugggcaagauccaggggguccucacccagaccacgcggcgcgacggcagcacccgggggcacaaggccaccgugagcaccggcuccgugcacuucacgcccaagcugggccgcauccaguucagcaccgacaccuccaacgacuucgagaccgggcagaacacgcgguucaccccggucggcguggugcaggacgggggcaccacccaccagaacgagccccagcaguggguccugcccgacuacagcgggcgcgacggccacaacgugcaccucgcccccgccguggccccguccuuccccggcgagcagcugcuguucuuccggagcacgaugcccgggugcuccggcuaccccaacaugaaccucgacugccugcugccgcaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccaugggcaacgggacgggccgccggcgcgcccucuga

SEQ ID NO: 10502 - RNA, 1608 nt, Artificial Sequence
  derived and/or modified sequence opt1 from capsid_protein__Norovirus__ACL31325
augaagauggccagcaacgacgccgcgcccuccaacgacggcgccgccgggcuggugccggaggucaacaacgagaccauggcccucgagcccguggugggcgccagcaucgcggcgccccugaccgggcagaacaacgucaucgaccccuggauccgccugaacuucgugcaggccccgaacggcgaguucacggugagcccccggaacucccccggggagguccuccugaaccuggagcucggccccgagcugaacccguaccuggcccaccucucccgcauguacaacggcuacgccgggggcguggaggugcagguccugcuggccgggaccgccuucaccgccggcaagcucguguucgccgcggugccgccccacuucccccuggagaacaucagccccgggcagaucaccauguucccccacgucaucaucgacgugcggacgcuggagcccgugcuccugccccugccggacguccgcaacaacuucuuccacuacaaccagcagaacgagccccggaugcgccucguggccaugcuguacacgccccugcgguccaacggcagcggcgacgacguguucaccgucuccugccgcgugcucacccggcccagcccggacuucgacuucaacuaccuggugccgcccaccgucgaguccaagaccaagcccuucacccugcccauccucaccaucggggagcugacgaacagccgcuuccccgugcccaucgacgagcuguacaccucccccaacgagagccucgugguccagccgcagaacggccggugcgcccuggacggggagcugcagggcaccacccagcuccugcccacggccaucugcuccuuccgcggccggaucaaccagaaggugagcggggagaaccacgucuggaacaugcaggucaccaacaucaacggcacccccuucgacccgaccgaggacgugcccgcgccccuggggacgcccgacuucuccggcaagcuguucggggugcucagccagcgcgaccacgccaacgccugccggucccacgacgccgugaucgccaccaacagcgccaaguucaccccgaagcugggcgcgauccagaucggcaccugggagcaggacgacgugcacaucaaccagcccacgaaguucacccccgucggccucuucgagaacgagggguucaaccaguggacccugcccaacuacagcggggcccugacccucaacaugggccuggccccgcccguggcccccacguuccccggggagcagauccuguucuuccgcucccacaucccgcucaagggcggcguggccgaccccgucaucgacugccugcugccccaggaguggauccagcaccucuaccaggagagcgcgcccucccagaccgacguggcccugauccgguucaccaacccggacaccgggcgcgugcuguucgaggccaagcuccaccggagcggcuacaucacggucgccaacaccgggucccgccccaucguggugcccgcgaacggcuacuuccgguucgacagcugggucaaccaguucuacucccuggcccccauggggaccggcaacggccgccgccgggugcaguga

SEQ ID NO: 10503 - RNA, 1629 nt, Artificial Sequence
  derived and/or modified sequence opt1 from capsid_protein__Norovirus__ACL31326
augaagauggccagcaacgacgccgcgcccuccaacgacggcgccgccagccuggugccggagggggucaacgagaccaugccccucgagcccguggccggcgccuccaucgcggcccccguggccgggcagaccaacaucaucgacccguggauccgcacgaacuucguccaggcccccaacggcgaguucaccgugagcccccggaacucccccggggagauccugcugaaccucgagcugggcccggaccugaaccccuaccucgcgcaccugagccgcauguacaacggcuacgccgggggcguggagguccaggugcugcucgccgggaacgccuucaccgccggcaagauccuguucgcggccaucccgcccaacuuccccguggacaugaucucccccgcccagaucaccaugcugccccaccucaucgucgacgugcggacgcuggagcccaucaugaucccgcugcccgacgugcgcaacgucuucuaccacuucaacaaccagccccagccccggaugcgccucguggccaugcuguacaccccgcugcggagcaacggguccggcgacgacguguucaccgucagcugccgcgugcucacccggcccacgcccgacuucgaguucaucuaccuggugcccccguccgucgagagcaagaccaagcccuucacccugcccauccucaccaucuccgagcugacgaacagccgcuuccccaucccgaucgagcagcuguacaccgcccccaacgagaccaacguggugcagugccagaacggccggugcacccucgacggggagcugcagggcacgacccagcugcucuccagcgcggucugcuccuaccgcgggcggaccguggccaacagcggcgacaacugggaccagaaccugcugcagcucaccuaccccaacggcgccuccuacgacccgacggacgaggugcccgcgccccuggggacccaggacuucagcggcaugcuguacgggguccucacccaggacaacgugaacgucagcaccggcgaggccaagaacgccaaggggaucuacaucuccacgaccagcggcaaguucacccccaagaucggcuccaucgggcugcacagcaucaccgagcacgugcacccgaaccagcagucccgcuucacgcccgugggcgucgccgugaacgagaacacccccuuccagcagugggugcugccccacuacgccgggagccucgcccugaacaccaaccuggccccggcggucgcccccaccuuccccggcgagcagcuccuguucuuccggucccgcgugcccugcgugcaggggcugcagggccaggacgccuucaucgacugccuccugccgcaggagugggucaaccacuucuaccaggaggccgcgcccagccaggccgacguggcccugauccgguacgugaaccccgacacgggccgcacccucuucgaggccaagcugcaccgguccggguucaucaccgucagccacaccggcgccuacccccugguggugccgcccaacgggcacuuccgcuucgacuccugggucaaccaguucuacagccucgcgcccaugggcacggggaacggccggcgccgcgugcaguga

SEQ ID NO: 10504 - RNA, 1623 nt, Artificial Sequence
  derived and/or modified sequence opt1 from capsid_protein__Norovirus__ACL31340
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgcguucgugguccagccccagaacgggcgcugcaccaccgacggcgugcuccuggggaccacgcagcucucccccgucaacaucugcaccuuccggggcaacgugaccaacaucgccggcagccagaccuacacgaugaaccuggccucccagaacuggaacaacuacgacccgaccgaggagauccccgcgccccuggggacccccgacuucgugggcaagauccaggggguccucacccagacgaccaagggcgacgggagcacccgcggccacaaggccaccgugagcacgggcuccgcccaguucaccccgaagcuggggagcgugcaguucuccaccgacaccagcacggacuucgagaccggccagaacacccgguucacccccgucggggugauccaggacggcuccacgacccacaagaacgagccccagcagugggugcugcccagcuacuccgggcgcgacagccacaacguccaccucgccccggccguggcccccaccuuccccggcgagcagauccuguucuuccgguccaccaugcccggcugcagcggguacccgaacauggaccuggacugccuccugccccaggagugggugcagcacuucuaccaggaguccgcccccgcgcagagcgacgucgcccugcuccgcuucgugaaccccgacaccggccgggugcuguucgagugcaagcugcacaaguccggguacgucacgguggcccacaccggccagcacgaccucgugaucccgcccaacggguacuuccgcuucgacagcugggucaaccaguucuacacccuggcccccaugggcaacggcgcggggcggcgccgggcccuguga

SEQ ID NO: 10505 - RNA, 1623 nt, Artificial Sequence
  derived and/or modified sequence opt1 from capsid_protein__Norovirus__ACL31354
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagcugaacgacuccaccaucaagcucaucgccaugcuguacacgccccugcgggcgaacaacgccggcgaggacguguucaccgugagcugccgcguccucacccggcccuccccggacuucgacuucaucuuccuggugccgcccaccguggagagccgcaccaagcccuucacgguccccauccugaccguggaggagaugaccaacucccgguuccccaucccccucgagaagcuguucaccggccccagcggggccuucgugguccagccgcagaacggccgcugcacgaccgacggggugcugcucggcaccacccagcugucccccgucaacaucugcacguuccggggcgacgugacccacaucgccgggagccgcgacuacaccaugaaccuggccucccucaacuggaacaacuacgaccccaccgaggagaucccggcgccccugggcacgcccgacuucguggggaagauccagggcguccugacccagaccaccaagggggacggcagcacgcggggccacaaggccaccguguacaccggguccgcccccuucaccccgaagcucggcagcgugcaguucagcacggacaccgagaacgacuucgagacccaccagaacaccaaguucacgcccgucggggugauccaggacggcuccaccacccaccgcaacgagccccagcagugggugcugcccagcuacuccgggcggaacguccacaacgugcaccuggccccggccguggcgcccaccuuccccggcgagcagcuccuguucuuccgcagcacgaugcccggcugcuccggguacccgaacauggaccuggacugccuccugccccaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcacggggcgccggcgcgcccuguga

SEQ ID NO: 10506 - RNA, 1623 nt, Artificial Sequence
  derived and/or modified sequence opt1 from capsid_protein__Norovirus__ACL31355
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgaggcccaccagaacaccaaguucacccccgucggggugauccaggacggcgggacgacccaccgcaacgagccccagcagugggugcuccccagcuacuccggccggaacguccacaacgugcaccuggccccggcgguggcccccaccuuccccggcgagcagcuccucuucuuccgcagcaccaugcccgggugcuccggcuacccgaacauggaccuggacugccugcucccccaggaguggguccagcacuucuaccaggaggccgcccccgcgcagagcgacguggcccugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggaccggccgccggcgcgcccuguga

SEQ ID NO: 10507 - RNA, 1623 nt, Artificial Sequence; identical to SEQ ID NO: 9282
  derived and/or modified sequence opt1 from capsid_protein__Norovirus__ACL31356

SEQ ID NO: 10508 - RNA, 1623 nt, Artificial Sequence
  derived and/or modified sequence opt1 from capsid_protein__Norovirus__ACL31358
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugauccacaucgccgggucccgcaacuacaccaugaaccuggccagccugaacuggaacaacuacgaccccaccgaggagaucccggcgccccucggcacccccgacuucguggggaagauccagggcguccugacgcagaccaccaagggggacggcuccacccggggccacaaggccacgguguacaccgggagcgcccccuucaccccgaagcugggcagcgugcaguucuccaccgacacggagaacgacuucgaggcccaccagaacaccaaguucacccccgucggggugauccaggacggcgggaccacgcaccgcaacgagccccagcagugggugcuccccagcuacuccggccggaacguccacaacgugcaccuggccccggcgguggcccccaccuuccccggcgagcagcuccucuucuuccgcagcaccaugcccgggugcuccggcuacccgaacauggaccuggacugccugcucccccaggaguggguccagcacuucuaccaggaggccgcccccgcgcagagcgacguggcccugcugcgguucgugaaccccgacaccgggcgcguccucuucgagugcaagcugcacaaguccggcuacgugacgguggcccacaccgggcagcacgaccuggucaucccgcccaacggcuacuuccgguucgacagcugggugaaccaguucuacacccucgcccccaugggcaacgggaccggccgccggcgcgcccuguga

SEQ ID NO: 10509 - RNA, 1647 nt, Artificial Sequence
  derived and/or modified sequence opt1 from capsid_protein__Norovirus__ACL31361
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacagcaccacgcgggcgcacgaggccaagaucgacaccaccuccgggcgcuucacccccaagcucggcagccuggagaucuccacggagagcgacgacuucgaccagaacaagccgacccgguucacccccgucggcaucgggguggaccacgaggccgacuuccagcagugggcccugcccgacuacgcgggccaguucacccacaacaugaaccucgcccccgccgucgccccgaacuuccccggggagcagcugcuguucuuccgcucccagcuccccagcuccggcgggcggagcaacggcauccuggacugccuggugccccaggagugggugcagcacuucuaccaggaguccgccccgagccagucccaggucgcgcucgugcgcuacaucaaccccgacacgggccgcgugcuguucgaggccaagcugcacaagcucggguucaucaccaucgccaagaacggcgacagccccaucaccgugcccccgaacggguacuuccgguucgaguccugggucaaccccuucuacacccuggcccccaugggcacggggaacggccgccggcgcauccaguga

SEQ ID NO: 10510 - RNA, 1623 nt, Artificial Sequence
  derived and/or modified sequence opt1 from capsid_protein__Norovirus__ACL31365
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccacaacuacaccaugaaccuggccagccugaacuggaacaacuacgaccccaccgaggagaucccggcgccccucggcacgcccgacuucguggggaagauccagggcguccugacccagaccaccaagggggacggcuccacgcgcggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccggaacgagccccagcagugggugcuccccuccuacagcggguccaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10511 - RNA, 1623 nt, Artificial Sequence
  derived and/or modified sequence opt1 from capsid_protein__Norovirus__ACL36375
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggaggugcccgcgccccucgggacgcccgacuucgucggcaagauccagggggugcugacccagaccaccaagggcgacgggagcacgcggggccacaaggccaccguguacaccggcuccgccccguucacccccaagcuggggagcguccaguucagcacggacaccgagaacgacuucgagacccaccagaacaccaaguucacgcccgugggcgugauccaggacggguccaccacccaccgcaacgagccccagcaguggguccucccgagcuacuccggccggaacgugcagaacgugcaccuggcccccgccgucgcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacguggcgcugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcgcccuguga

SEQ ID NO: 10512 - RNA, 1593 nt, Artificial Sequence; identical to SEQ ID NO: 10425
  derived and/or modified sequence opt1 from capsid_protein__Norovirus__ACN32270

SEQ ID NO: 10513 - RNA, 1608 nt, Artificial Sequence
  derived and/or modified sequence opt1 from capsid_protein__Norovirus__ACT52403
augaagauggccagcaacgacgccucccccagcuccgacggcagcgcgaaccuggugccggagaucaacaacgaggucauggcccucgagcccguggccggggccgccaucgcggcccccguggccggccagcagaacaucaucgaccccuggauccgcaacaacuucguccaggcccccgggggcgaguucaccgugagcccccgguccgcgcccggggaggugcugcugaaccucccccuguccccggacaucaaccccuaccuggcccaccucagccgcauguacaacggcuacgccggcggggucgagguggaggugguccuggccggcaacgccuucaccgcggggaagaucaucuucgccgccgugccgcccaacuucccgcccgagaaccugucccccagccagaucacgaugcucccccacaucaucguggacguccggcagcuggagccggugcgcaucccccugcccgacgugcggaacaacuucuaccacuacucccgcgagaacgacagcacccuccggcugaucgccaugcuguacacgccccuccgcgccaacaacgcgggcgacgacgucuucaccguguccugccgggugcugacccgcccgagccccgacuucgacuucaucuuccuggucccgcccaccguggaguccaagagcaagcccuucaccauccccauccucaccaucgaggagaugacgaacucccgguuccccgcgccccuggagaugaugaccaccgggccgagccacgacaucgugguccagccccagaacggccgcugcaccaucgacggcgugcugcucgggacgacccagcugucccccgugaacaucugcagcaugcggggcgucccgaccaagcgcaccaacgggacggacaacugcuucgugcagcuggagaaccccaacggcagcgccuacgaccccaccgaggacauccccgccguccucggcuccccggacuucgugggggaguucuacggcaccaucacccagcggagccccaacaacuccacgcgcgcccaccccuucacccugaacaccgggagcccccgguacaccccgaagaucggcuccguggacauccacgucacggacguggaggaccugaacgaccacgagcccgugaagcucacccccgucgggcugagcggcuccagcggcuccauccaccaguggcagcugcccaacuacagcgggguggccacccacaacaugcaccucgccccguccguggcgccccuguuccccggcgagcagauccuguucuuccgcagcaccguccccgggugcggcggguacccgaacacgaacaucgacugccucaucccccaggagugggugcagcacuucuaccaggagggcgcccccgcccggaccgacguggcccugcugcgcuucaucaaccccgacaccggccggguccucuucgagugcaagcugcacaagcacggguucaucaccguggccuacuccggcaaccacgaccuggugaugccgcccaacggguacuuccgcuucgagagcugggucaaccaguuccacacgcucgcccccaugggcaccggguccggccgccggcgcauccaguga

SEQ ID NO: 10514 - RNA, 1647 nt, Artificial Sequence
  derived and/or modified sequence opt1 from capsid_protein__Norovirus__ACT52405
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucauggacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgacaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacggccgggcgcuucacccccaagcucggcagccuggagaucuccaccgagagcaacgacuucgaccagaaccagccgacccgguucacgcccgugggcaucggggucgaccacgaggccgacuuccagcaguggucccugcccgacuacagcggccaguucacccacaacaugaaccucgugcccgccguggcgccgaacuuccccggggagcagcugcuguucuuccgcucccagcuccccagcuccggcgggcggagcaacggcauccuggacugccuggucccccaggagugggugcagcacuucuaccaggaguccgccccggcccagacccagguggcccucguccgcuacgugaaccccgacaccggccgcgugcuguucgaggccaagcugcacaagcucggguucaugacgaucgcgaagaacggcgacagccccaucaccgugcccccgaacggguacuuccgguucgaguccugggucaaccccuucuacacccuggcccccaugggcaccgggaacggccgccggcgcaaccaguga

SEQ ID NO: 10515 - RNA, 1647 nt, Artificial Sequence
  derived and/or modified sequence opt1 from capsid_protein__Norovirus__ACT52407
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucagccaccuggcccggauguacaacggguacgccggcggguucgagguccaggugguccuggccggcaacgccuucaccgcggggaagaucaucuucgccgccaucccgcccaacuuccccaucgacaaccucuccgccgcccagaucaccaugugcccccacgugaucguggacguccgccagcuggagcccgugaaccugcccaugcccgacgugcggaacaacuucuuccacuacaaccagggcagcgacucccgccuccggcugaucgcgaugcuguacaccccgcuccgcgccaacaacagcggcgacgacgucuucacgguguccugccgggugcugacccgccccagccccgacuucuccuucaacuuccuggugcccccgaccguggagagcaagaccaagcccuucacgcuccccauccugaccaucuccgagaugagcaacucccgguuccccgugccgaucgacagccugcacaccucccccaccgagaacaucgucgugcagugccagaacgggcgcgugacgcucgacggcgagcugauggggaccacccagcugcuccccagccagaucugcgccuuccggggcguccugacccgcuccacgagccgggccagcgaccaggccgacaccgcgacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacagcaccacccgggcccacgaggccaaggucgacaccacggcggggcgcuucacccccaagcucggcucccuggagaucagcaccgaguccgacgacuucgaccagaaccagccgacccgguucacgcccgugggcaucggggucgaccacgaggccgacuuccagcaguggagccugcccgacuacuccggccaguucacccacaacaugaaccucgcccccgccguggcgccgaacuuccccggggagcagcugcuguucuuccgcagccagcuccccuccagcggcgggcgguccaacggcauccuggacugccuggugccccaggaguggguccagcacuucuaccaggagagcgccccggcccagacccagguggcccucgugcgcuacgucaaccccgacaccggccgcgugcuguucgaggccaagcugcacaagcucggguucaugacgaucgcgaagaacggcgacucccccaucaccgugcccccgaacggguacuuccgguucgagagcugggucaaccccuucuacacccuggcccccaugggcaccgggaacggccgccggcgcaaccaguga

SEQ ID NO: 10516 - RNA, 1608 nt, Artificial Sequence
  derived and/or modified sequence opt1 from capsid_protein__Norovirus__ACT52409
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgagaaccucagccccgggcagaucaccauguucccccacgucaucaucgacgugcggacccuggagcccgugcugcucccccugccggacguccgcaacuccuucuuccacuacaaccaggagcccgagccccggaugcgccugguggccaugcucuacacgccccugcggagcaacggcuccggcgacgacguguucaccgucagcugccgcgugcugacccggccgucccccgacuucgacuucaacuaccucgugccgcccaccgucgagagcaagacgaagcccuucacccugcccauccugaccaucggggagcucuccaacagccgcuuccccgcccccaucgacgagcuguacaccuccccgaacgagggccugguggugcagccccagaacgggcggagcacgcucgacggcgagcugcugggcaccacccagcucguccccuccaacaucugcagccugcgcgggcggaccaacgcccaccucccggacaaccagcaccgcuggaacaugcaggucacgaaccccaacggcacccccuucgaccccaccgaggacgugccggcgccccucgggacccccgacuuccuggccaacaucuacggcgugacgucccagcggaaccccaacaacacgugccgcgcccacgacgggauccuggccaccuggagcccgaaguucacccccaagcucggcagcgugguccugggcaccugggaggaccgggacuucgacaucaaccagcccacccgcuucacccccguggggcuguacgacaccgaccacuucaaccagugggcccucccgaacuacuccggcgcgcugacgcugaacaugaaccucgcccccagcguggcgccccuguuccccggggagcagcugcuguucuuccggucccacaucccgcugaagggcgggaccagcaacggcgccaucgacugccugcucccccaggaguggguccagcacuucuaccaggaguccgcccccagcuccaccgacguggcccugauccgcuacaccaaccccgacacgggccgggugcuguucgaggccaagcugcaccgccagggguucaucaccgucagcaacuccggcagccgcccgaucguggugccgcccaacggguacuuccgguucgacuccugggucaaccaguucuacagccucgcccccaugggcaccgggaacggccgccggcgcgugcaguga

SEQ ID NO: 10517 - RNA, 1623 nt, Artificial Sequence
  derived and/or modified sequence opt1 from capsid_protein__Norovirus__ACT78459
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgaccacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgggcccucuga

SEQ ID NO: 10518 - RNA, 1641 nt, Artificial Sequence
  derived and/or modified sequence opt1 from capsid_protein__Norovirus__ACU56258
augaugauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcaacagcgacuccuucgucguggcggggcgcgugcugaccgcccccagcuccgacuucagcuuccucuuccuggugcccccgaccaucgagcagaagacccgggccuucaccguccccaacaucccccugcagacgcucuccaacagccgcuuccccucccugauccagggcaugauccugagcccggacgccagccaggugguccaguuccagaacggccggugccucaucgacgggcagcugcugggcaccacccccgccaccuccgggcagcuguuccgcgugcggggcaagaucaaccagggggcgcgcacgcucaaccugaccgagguggacggcaagcccuucauggccuucgacagccccgccccggucggcuuccccgacuucgggaagugcgacuggcacaugcggaucuccaagacccccaacaacaccagcuccggcgacccgaugcgcagcguggacguccagacggacgugcagggguucgugccccaccucggcuccauccaguucgacgaggucuucaaccaccccaccggggacuacaucggcaccaucgaguggaucagccagcccuccaccccgcccggcacggacaucaaccugugggagauccccgacuacgggagcucccugagccaggccgccaaccucgcgcccccgguguucccgcccggcuucggggaggcccugguguacuucgucuccgccuuccccggccccaacaaccggagcgcccccaacgacgugcccugccugcucccccaggaguacgugacccacuucgucuccgagcaggccccgaccaugggggacgcggcccugcugcacuacguggaccccgacaccaaccgcaaccucggcgaguucaagcuguaccccggcggguaccugacgugcgugcccaacggcgucggggccggcccgcagcagcucccccugaacggcguguuccuguucgugagcugggucucccgguucuaccagcucaagcccguggggaccgccagcaccgcgcgcggccggcugggggugcgccggaucuga

SEQ ID NO: 10519 - RNA, 1638 nt, Artificial Sequence
  derived and/or modified sequence opt1 from capsid_protein__Norovirus__ACX33982
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacguccucuucgaccugcagcugggcccccaccucaacccguuccugagccaccuggcccagauguacaacgggugggugggcaacaugaaggugaagguccuccuggccgggaacgccuucaccgcgggcaagaucaucaucuccugcaucccgcccggguucgccgcccagaacuucagcaucgcccaggccaccauguucccccacgugaucgcggacgugcgcguccuggagcccaucgaggugccccucgaggacgugcggaacguccuguuccacaacaacgacaacacccccacgaugcgccuggugugcaugcucuacacgccccugcgggccuccggcagcuccagcggcaccgacccguucgugaucgccgggcgcguccugaccugccccucccccgacuucagcuuccucuuccuggugcccccgaacguggagcagaagaccaagcccuucuccguccccaaccugccccucaacacccugagcaacucccgggugccgagccugaucaaguccaugaugaucagccgcgaccacggccagauggugcaguuccagaacgggcgggucacccucgacggccagcugcagggcaccacgcccaccuccgccagccagcugugcaagauccgcgggagcguguuccacgccaacggcgggaacggcuacaaccucaccgagcuggacgggucccccuaccacgcguucgagagccccgccccgaucggcuuccccgaccugggcgagugcgacuggcacauggaggccucccccaucacccaguucgacacgggggacgugaucaagcagaucaacgucaagcaggagagcgccuucgccccgcaccucggcaccgugcaggcggacgggcuguccgacgucagcgccaacaccaacaugaucgccaagcugggcugggugucccccgugagcgacgggcaccgguccgacgucgaccccugggugaucccccgcuacggcagcacccucacggaggccgcgcagcuggccccgcccaucuacccgcccggcuucggggaggccaucguguucuucauguccgacuuccccaucgcccacggcaccaacgggcugagcguccccugcaccaucccccaggaguucgugacccacuucgugaacgagcaggcccccacgcggggcgaggcggcccuccugcacuaccuggacccggacacccaccgcaaccucggggaguucaagcuguaccccgacggcuucaugaccugcguccccaacuccagcggcaccgggccccagacgcugccgaucaacggcguguucguguucgucuccugggugagccgguucuaccagcucaagcccguggggaccgccggccccgcccgccggcugggcauccgccgguccuga

SEQ ID NO: 10520 - RNA, 1638 nt, Artificial Sequence
  derived and/or modified sequence opt1 from capsid_protein__Norovirus__ACX33983
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacguccucuucgaccugcagcugggcccccaccucaacccguuccugagccaccuggcccagauguacaacgggugggugggcaacaugaaggugaagguccuccuggccgggaacgccuucaccgcgggcaagaucaucaucuccugcaucccgcccggguucguggcccagaacuucagcaucgcccaggccaccauguucccccacgugaucgccgacguccgcgugcuggagcccaucgaggugccccucgaggacguccggaacgugcuguuccacaacaacgacaacacccccacgaugcgccuggugugcaugcucuacacgccccugcgggcgggcggcuccagcuccgggaccgacccguucgucaucgccggccgcgugcugaccugccccagccccgacuucuccuuccucuuccuggugcccccgaacgucgagcagaagaccaagcccuucagcgugcccaaccugccccucaacacccuguccaacagccgggugccgucccugaucaagagcaugaugaucucccgcgaccacgggcagaugguccaguuccagaacggccgggugacccucgacggccagcugcaggggaccacgcccaccagcgccucccagcugugcaagauccgcggcagcguguuccacgccaacgggggcaacggguacaaccucaccgagcuggacggcagccccuaccacgccuucgagucccccgcgccgaucggcuuccccgaccugggggagugcgacuggcacauggaggccagccccaccacgcaguucgacaccggcgacgucaucaagcagaucaacgugaagcaggaguccgccuucgccccgcaccucgggaccguccaggccgacggccugagcgacguguccgcgaacaccaacaugaucgccaagcuggggugggugagccccgucuccgacggccaccggagcgacguggaccccugggugaucccccgcuacggcuccacgcucaccgaggccgcccagcuggcgccgcccaucuacccgcccggguucggcgaggccaucgucuucuucaugagcgacuuccccaucgcccacgggaccaacggccuguccgugcccugcaccaucccccaggaguucgugacgcacuucgucaacgagcaggcccccacccgcggggaggccgcgcuccugcacuaccuggacccggacacccaccggaaccucggcgaguucaagcuguaccccgacggcuucaugaccugcgugcccaacagcuccgggacgggcccccagacccugccgaucaacgggguguucgucuucgugagcugggugucccgguucuaccagcucaagcccgucggcaccgccggccccgcccgccggcuggggauccgccggagcuga

SEQ ID NO: 10521 - RNA, 1611 nt, Artificial Sequence
  derived and/or modified sequence opt1 from capsid_protein__Norovirus__ACX81341
augaagauggccagcaacgacgccacccccuccgacgacggcgcggccgggcuggugccggagaucaacaacgaggucauggcccucgagcccguggccggcgccagcaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccuccuuccccuacgagaaccugagccccgcccagcucaccaugugcccccacgugaucgucgacgugcggcagcuggagcccgugcugcuccccaugccggacauccgcaacgucuucuaccacuacaaccagaacaacucccccaagcugcggcugguggccaugcucuacacgccccugcgcgcgaacaacagcggggacgacguguucaccgucuccugccgggugcugacccgccccagcccggacuuccaguucaccuuccucgugccgcccaccgucgaguccaagaccaagaacuucacgcugcccgugcugcgggugagcgagaugaccaacucccgcuuccccgucgugcucgaccagauguacaccagccggaacgagaacaucaucgugcagccccagaacggccgcugcaccacggacggcgagcugcuggggaccaccauccuccaguccgucagcaucugcaacuucaagggcaccaugcaggccaagcugaacgaggagccccgguaccagcugcagcucacgaaccuggacgggucccccaucgacccgaccgacgacaugcccgcgccccugggcaccccggacuuccaggccaugcucuacggcguggccagccagcgcuccagcaucgacaacgccacccgggcccacgacgcccagaucgacacggccggggacaccuucgcccccaagaucggccagguccgcuucaagagcuccagcaacgacuucgaccugcacgaccccaccaaguucacccccaucggggugaacguggacgaccagcacccguuccggcaguggucccugcccaacuacggcgggcaccucgcgcugaacaaccaccuggcccccgccgucacgccccucuucccgggcgagcagauccuguucuuccgcagcuacauccccuccgccggcgggcacaccgacggcgcgauggacugccugcucccccaggaguggguggagcacuucuaccaggaggccgcccccagccaguccgacaucgcccuggugcgguucaucaacccggacaccgggcgcguccuguucgaggccaagcuccacaagcagggcuuccugaccaucgcggccagcggggaccaccccaucgugaugcccacgaacggcuacuuccgguucgaggccugggugaaccccuucuacacccuggccccggucggcaccggguccggccgccgccggauccaguga

SEQ ID NO: 10522 - RNA, 1611 nt, Artificial Sequence; identical to SEQ ID NO: 10521
  derived and/or modified sequence opt1 from capsid_protein__Norovirus__ACX81343

SEQ ID NO: 10523 - RNA, 1611 nt, Artificial Sequence
  derived and/or modified sequence opt1 from capsid_protein__Norovirus__ACX81345
augaagauggccagcaacgacgccacccccuccgacgacggcgcggccgggcuggugccggagaucaacagcgaggucauggcccucgagcccguggccggcgccucccuggcggcccccguggucgggcagcagaacaucaucgaccccuggauccgcaacaacuucgugcaggccccggccggcgaguucaccgugagcccccggaacucccccggggagcugcuccuggaccuggagcucggccccgagcugaacccguaccuggcgcaccucgcccgcauguacaacggccacgccgggggcauggagguccagaucgugcuggccgggaacgccuucacggcgggcaagauccuguucgccgccaucccgcccagcuuccccuacgagaaccucucccccgcccagcugaccaugagcccccacgugaucgucgacgugcggcagcugaagcccgugcuccugcccaugccggacaucaagaacgacuucaaccacuacaaccagaagaacaacaccaagcugcgccucgucgccaugcuguacacgccccugcgggcgaacaacuccggggacgacgugugcaccgagagcugccgcgugcucacccggcccucccccgacuuccaguucaccuuccuggucccgcccaccguggagagcaagacgaagaacuucacccugcccgugcuccgcgucuccgagaugaccaacagccgguuccccguggugcuggaccagauguacaccucccgcaacgagaacaucaucguccagccgcagaacggccggugcacgaccgacggcgagcugcucgggaccaccauccugcagagcguguccaucugcaacuucaagggcacgaugcaggccaagcugaacgaggagccccgcuaccagcuccagcugaccaaccuggacgggagccccaucgaccccaccgacgacaugccggcgccccucggcacccccgacuuccaggccaugcuguacggcguggccucccagcggagcagcaucgacaacgccacgcgcgcccacgacgcccagaucgacaccgccggggacaccuucgccccgaagaucggccagguccgguucaaguccagcuccaacgacuucgaccugcacgaccccaccaaguucacgcccaucggggugaacgucgacgaccagcaccccuuccgccaguggagccucccgaacuacggcgggcaccuggcgcugaacaaccaccucgcccccgccgugacgccccuguuccccggcgagcagauccuguucuuccgguccuacaucccgagcgccggcgggcacaccgacggcgcgauggacugccuccugccccaggaguggguggagcacuucuaccaggaggccgcccccucccagagcgacaucgcccugguccgcuucaucaaccccgacaccgggcggguccucuucgaggccaagcugcacaagcagggcuuccugaccaucgcggccuccggggaccacccgaucgugaugcccaccaacggcuacuuccgcuucgaggccugggugaaccccuucuacacccucgcccccgugggcaccgggagcggccggcgccgcauccaguga

SEQ ID NO: 10524 - RNA, 1611 nt, Artificial Sequence; identical to SEQ ID NO: 10521
  derived and/or modified sequence opt1 from capsid_protein__Norovirus__ACX81347

SEQ ID NO: 10525 - RNA, 1611 nt, Artificial Sequence; identical to SEQ ID NO: 10521
  derived and/or modified sequence opt1 from capsid_protein__Norovirus__ACX81349

SEQ ID NO: 10526 - RNA, 1611 nt, Artificial Sequence; identical to SEQ ID NO: 10521
  derived and/or modified sequence opt1 from capsid_protein__Norovirus__ACX81351

SEQ ID NO: 10527 - RNA, 1611 nt, Artificial Sequence
  derived and/or modified sequence opt1 from capsid_protein__Norovirus__ACX81353
augaagauggccagcaacgacgccacccccuccgacgacggcgcggccgggcuggugccggagaucaacaacgaggucauggcccucgagcccguggccggcgccagcaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccuccuuccccuacgagaaccugagccccgcccagcucaccaugugcccccacgugaucgucgacgugcggcagcuggagcccgugcugcuccccaugccggacauccgcaacgucuucuaccacuacaaccagaacaacucccccaagcugcggcugguggccaugcucuacacgccccugcgcgcgaacaacagcggggacgacguguucaccgucuccugccgggugcugacccgccccagcccggacuuccaguucaccuuccucgugccgcccaccgucgaguccaagaccaagaacuucacgcugcccgugcugcgggugagcgagaugaccaacucccgcuuccccgucgugcucgaccagauguacaccagccggaacgagaacaucaucgugcagccccagaacggccgcugcaccacggacggcgagcugcuggggaccaccauccuccaguccgucagcaucugcaacuucaagggcaccaugcaggccaagcugaacgaggagccccgguaccagcugcagcucacgaaccuggacgggucccccaucgacccgaccgacgacaugcccgcgccccugggcaccccggacuuccaggccaugcucuacggcguggccagccagcgcuccagccgggacaacgccacccgcgcccacgacgcccagaucgacacggccggggacaccuucgcccccaagaucggccagguccgguucaagagcuccagcaacgacuucgaccugcacgaccccaccaaguucacccccaucggggugaacguggacgaccagcacccguuccgccaguggucccugcccaacuacggcgggcaccucgcgcugaacaaccaccuggcccccgccgucacgccccucuucccgggcgagcagauccuguucuuccggagcuacauccccuccgccggcgggcacaccgacggcgcgauggacugccugcucccccaggaguggguggagcacuucuaccaggaggccgcccccagccaguccgacaucgcccuggugcgcuucaucaacccggacaccgggcggguccuguucgaggccaagcuccacaagcagggcuuccugaccaucgcggccagcggggaccaccccaucgugaugcccacgaacggcuacuuccgcuucgaggccugggugaaccccuucuacacccuggccccggucggcaccggguccggccgccggcgcauccaguga

SEQ ID NO: 10528 - RNA, 1611 nt, Artificial Sequence; identical to SEQ ID NO: 10521
  derived and/or modified sequence opt1 from capsid_protein__Norovirus__ACX81355

SEQ ID NO: 10529 - RNA, 1623 nt, Artificial Sequence
  derived and/or modified sequence opt1 from capsid_protein__Norovirus__ACX85806
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucgucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggggacgacguguucaccgucuccugccgcgugcugacccggccgagccccgacuucgacuucaucuuccucgugccgcccaccgucgagucccgcacgaagcccuucagcgugcccauccugaccguggaggagaugaccaacucccgguuccccaucccccuggagaagcuguucaccggcccgagcuccgccuucgucgugcagccccagaacggccgcugcacgaccgacgggguccuccugggcaccacccagcucagccccgugaacaucugcacguuccgggggaacgugacccacaucgccggcacccaggaguacaccaugaaccuggccucccagaacuggaacaacuacgacccgacggaggagauccccgcgccccugggcacccccgacuucgucgggaagauccagggcgugcucacccagaccacgcgccgggacgggagcacccgcggccacaaggccaccgugagcaccggguccguccacuucacgccgaagcugggccggauccaguucagcaccgacaccuccaacgacuucgagaccggccagaacacgcgcuucacccccgugggggugguccaggacggcagcaccacccaccagaacgagccccagcagugggugcugcccaacuacuccgggcgggacagccacaacgugcaccucgccccggccgucgcccccuccuuccccggcgagcagcugcuguucuuccgcagcacgaugcccgggugcuccggcuacccgaacaugaaccucgacugccugcugccccaggagugggugcagcacuucuaccaggaggccgcgcccgcccagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcgcccaugggcaacgggacgggccgccgccgggcccucuga

SEQ ID NO: 10530 - RNA, 1647 nt, Artificial Sequence
  derived and/or modified sequence opt1 from capsid_protein__Norovirus__ACX85807
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgcccucacggccgggaagaucaucuucgccgccaucccgcccaacuuccccaucgacaaccuguccgcggcccagaucaccaugugcccccacgugaucguggacguccgccagcuggagcccgugaaccuccccaugcccgacgugcggaacaacuucuuccacuacaaccagggcagcgacucccgccugcggcugaucgccaugcucuacaccccgcugcgcgccaacaacagcggcgacgacgucuucaccguguccugccgggugcugacgcgccccagccccgacuucuccuucaacuuccucgugcccccgaccguggagagcaagaccaagcccuucucccugcccauccugaccaucagcgagauguccaacagccgguuccccgugccgaucgacucccuccacacgagccccaccgagaacaucgucgugcagugccagaacgggcgcgugacccuggacggcgagcugauggggaccacgcagcuccugcccucccagaucugcgccuuccggggcguccugacccgcagcaccagccgggcguccgaccaggccgacaccgccacgccccgccucuucaacuacuacuggcacauccagcuggacaaccugaacggcaccccguacgaccccgccgaggacauccccgggccgcucggcacccccgacuuccgggggaagguguucggcguggccagccagcgcaaccccgacgcgaccacgcgggcccacgaggccaagaucgacaccaccuccgggcgcuucacccccaagcugggcagccuggagaucuccacggagagcgacgacuucgaccagaacaagccgacccgguucacccccgucggcaucgggguggaccacgaggaggacuuccagcaguggacccuccccgacuacgccggccaguucacgcacaacaugaaccuggcgcccgccgucgccccgaacuuccccggggagcagcuccuguucuuccgcucccagcugcccagcuccggcgggcggagcaacggcauccuggacugccucgugccccaggagugggugcagcacuucuaccaggaguccgccccgagccagacccaggucgcccuggugcgcuacaucaaccccgacaccggccgcgugcuguucgaggcgaagcuccacaagcugggguucaugaccaucgccaagaacggcgacucccccaucacggugcccccgaacggguacuuccgguucgagagcugggucaaccccuucuacacccuggcccccaugggcaccgggaacggccgccggcgcauccaguga

SEQ ID NO: 10531 - RNA, 1623 nt, Artificial Sequence
  derived and/or modified sequence opt1 from capsid_protein__Norovirus__ACX85809
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucaucgccaugcuguacacgccccugcgcgccaacaacuccggcgacgacguguucaccgucagcuggcgggggcucaccaagaccuccccggacuucgaguucaccuuccuggugccgcccaccguggagagcaagacgaagcaguucacccugcccauccucaagaucuccgagaugaccaacagccgcuuccccguccccguggagaugauguacaccgcccggaacgagaaccaggugguccagccccagaacggccgcgugacgcuggacggggagcugcucggcaccacgccccugcuggcggugaacaucugcaaguucaagggcgaggucaucgccaagaacggggacgugcgguccuaccgcauggacauggagaucaccaacaccgacggcaccccgaucgaccccaccgaggacacccccgggccgaucggcagccccgacuuccaggggauccucuucggcguggccucccagcggaacaagaacgagcagaaccccgccacgcgcgcccacgaggcgaacaucaacaccggcggggaccaguacgcccccaagcuggcccaggucaaguucuucagcgagucccaggacuucgaggugcaccagccgaccgucuucacccccgugggcguggccggggacacgagccaccccuuccggcaguggguccugccccgcuacggcgggcaccucaccaacaacacccaccuggccccggcgguggcgccccuguuccccggcgagcagauccucuucuuccggucccagauccccagcagcggcgggcacgagcugggcuacauggacugccuggugccgcaggaguggguccagcacuucuaccaggaggccgccaccgcccaguccgagguggcccucauccgcuucaucaaccccgacacggggcgggugcuguucgaggccaagcugcacaagcagggcuucaucaccgucgcccacaccggggacaaccccaucgugaugcccccgaacggcuacuuccgcuucgaggccugggugaaccaguucuacagccucgcgcccgucggcaccgggaacggccggcgccgcauccaguga

SEQ ID NO: 10532 - RNA, 1623 nt, Artificial Sequence
  derived and/or modified sequence opt1 from capsid_protein__Norovirus__ACX85810
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucaucgccaugcuguacacgccccugcgcgccaacaacuccggcgacgacguguucaccgucagcugccgggugcucaccaagccgucccccgacuucgaguucaccuuccuggugccgcccaccgucgagagcaagaccaagcaguucacgcugcccauccucaagaucuccgagaugaccaacagccgcuuccccgugcccguggagaugauguacaccgcccggaacgagaaccaggucgugcagccccagaacgggcgcgugacccuggacggcgagcugcucgggacgaccccgcugcuggcggucaacaucugcaaguucaagggcgaggugaucgccaagaacggcgacgugcgguccuaccgcauggacauggagaucaccaacaccgacgggacgcccaucgaccccaccgaggacaccccgggccccaucgggagccccgacuuccagggcauccucuucggggucgccucccagcggaacaagaacgagcagaaccccgccacccgcgcccacgaggcgaacaucaacacgggcggcgaccaguacgccccgaagcuggcccaggugaaguucuucagcgagucccaggacuucgagguccaccagcccaccguguucacccccgugggggucgccggcgacaccagccaccccuuccggcagugggugcugccgcgcuacgggggccaccucacgaacaacacccaccuggcccccgcgguggcgccccuguuccccggggagcagauccucuucuuccggucccagaucccgagcagcggcggccacgagcugggguacauggacugccuggucccccaggagugggugcagcacuucuaccaggaggccgccgccgcccaguccgagguggcccucauccgcuucaucaaccccgacaccggccggguccuguucgaggccaagcugcacaagcagggguucaucaccguggcccacacgggcgacaaccccaucgugaugccgcccaacggguacuuccgcuucgaggcgugggucaaccaguucuacagccucgcccccgugggcaccggcaacgggcggcgccgcauccaguga

SEQ ID NO: 10533 - RNA, 1569 nt, Artificial Sequence
  derived and/or modified sequence opt1 from capsid_protein__Norovirus__ACY41155
augaagaugaccgaccgcgacaccacggaccccgccccggcccugggccaggugcucccgcccgaggucgaggcgagcgugcccguggagcccaccgccggggcccccgucgccgccgcgaccgccggccaggugaaccccaucgaccccuggaucuucgccaacuucgugcaggccccgcagggggaguucaccaucucccccaacaacaaccccggcgagauccuguucgagcuggagcucgggcccgagcugaacccguaccuggcgcaccuccggcgcauguacaacggcuggacgggcagcaugcggguccgcgugcugcuggccgggaacgccuucuccgccggcaagguggucguguucugcgugccgcccggguucgacgccagcuaccucacccccucccaggcgacccaguucccccacguccugaucgacgugcgggcccccgagcccguggagaugccccuggaggacguccgcaacauccucuuccaccagggcccggacagccggaugcgccugauggggaugcuguacacgccccuccgggccaacuccggcgccgaccccuucguggugaccggccgcguccugaccugccccagcccgaacuucuccuucuucuuccuggugccgcccaccguggaggagcgggagguccccuucacccuccccaaccugcccgugaacaaccugagccacucccgcgugauggagcccaucgcccagaugaugagcucccggaaccucccggcgagcguccaguuccagaacgggcgcugcacgcuggccggcgaccugcucgggaccacccccuccagccccgccgaccugggcaccuucgugggccugaucgccgagcccgggucccgggucguggagcuguuccagccgaaccaggaggacuuccacgccggcagcgcgcccgcgccccucggguuccccgacuucuccgacugcagccugacguucguggucgccagcuccaccaccgugggcgagcgcaccgugaacagccgguccccgcagaacuucacgcccgcccucgggcacgucacccuggacgaggaggcccccgccgaccuguuccgcgcccggcuccgcaaccugugggaccccaccgagcacagcuucuggcggaucccggacuaccgcgccgacgugcugggcuccgaguucgcccccagcguguccgcgcccggcgucggggagacccuccuguucuucaugugcaacgugccccgccugaacggcgccaacccgaaccccugccccugccuccugccccaggaguggaucacgcacuucgugagcgagcgggccgcccugcagggggacgucgcccuccugaacuacgugaacccgaacaccggccgcgugcuguucgagugcaagcucuacgcgaacggguuccugaccgucaaccugggcgccuccgaccaggccacccuccccguggacggcaucuucaaguucgugagcugggucuccuucuacuaccagcugcggcccguggggaacgccagcgugggccgccggcugccccgccugaacggguucuga

SEQ ID NO: 10534 - RNA, 1623 nt, Artificial Sequence; identical to SEQ ID NO: 9868
  derived and/or modified sequence opt1 from capsid_protein__Norovirus__ADA77528

SEQ ID NO: 10535 - RNA, 1620 nt, Artificial Sequence
  derived and/or modified sequence opt1 from capsid_protein__Norovirus__ADB22512
augaagauggccagcaacgacgccgcgcccuccaacgacggcgccaccgggcuggugccggaggucaacaccgagacgcucccccuggagcccguggccggcgccgccaucgcggcccccgugaccgggcagaacaacaucaucgacccguggauccgcagcaacuucguccaggcccccaacggcgaguucaccgugagcccccggaacucccccggggagauccugaugaaccucgagcugggcccggaccugaaccccuaccucgcccaccugucccgcauguacaacggcuacgccgggggcguggagguccaggugcugcucgccgggaacgccuucaccgccggcaagauccuguucgccgcggugccgcccaacuuccccgucgacaugcugagccccgcccagaucacgaugcucccccaccugaucguggacgugcggacccuggagcccaucaugaucccgcuccccgacguccgcaacguguucuaccacuucaacaaccagcccgcgccccggaugcgccugguggccaugcuguacaccccgcuccgguccaacgggagcggcgacgacgucuucaccguguccugccgcgugcugacgcggcccacccccgacuucgaguucaccuaccuggugcccccgagcgucgaguccaagaccaagcccuucacgcuccccauccugaccaucggcgagcugaccaacagccgcuuccccgccccgaucgaccagcucuacaccucccccaacgcggacguggucgugcagccccagaacgggcggugcacgcuggacggcgagcugcaggggaccacccagcuccugaccacggccaucugcagcuaccgcggcaugaccuccaacccgaccagcgacuacugggacggccaccuccugcaccuggugcaccccaacggggccaccuacgaccccacggaggacguccccgccccguucggcacccaggacuuccgggggauccuguacggcaugcucacccagaacccccgcaccuccggggacgaggccgcgaacagccacggcguguacaucuccagcacgagcgagaaguucacccccaagcugggcaccaucgggcugcaccagguccagggcgaccacucccagcagcagcagagcaaguucacccccguggggaucgccgugaacggcaacacgccguuccggcagugggagcuccccaacuacuccggggcccugacccugaacaccaaccucgcccccgccgucggccccaacuucccgggcgagcagauccuguucuuccgcagcaacgugcccuccgugcagggcgggcagcccaucgagaucgacugccugaucccccaggagugggucagccacuucuaccaggaguccgcgccgagccaguccgacguggcccucgugcgguacgucaaccccgacaccgggcgcacgaucuucgaggccaagcugcaccggcagggcuucaucaccaucgccgcgaccgggagcaaccccgugguggugcccccgaacggcuacuuccgcuucgacuccugggucaaccaguucuacgcccuggcccccaugggcaccgggaacggccggcgccgcauccaguga

SEQ ID NO: 10536 - RNA, 1623 nt, Artificial Sequence
  derived and/or modified sequence opt1 from capsid_protein__Norovirus__ADC91993
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcuccgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacguccagaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10537 - RNA, 1623 nt, Artificial Sequence
  derived and/or modified sequence opt1 from capsid_protein__Norovirus__ADC91994
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggccacccagaacuggaacagcuacgacccgaccgaggagauccccgcgccccuggggacccccgacuucgugggcaagauccaggggguccucacgcagaccacccgggccgacggcuccacccgcgggcacaaggccacgguguacaccggcagcgccgacuucagcccgaagcugggccgggugcaguucgccaccgacaccgacaacgacuucgacgccaaccagaacacgaaguucacccccgucggggugauccaggacggcgacaccgcccaccgcaacgagccccagcagugggugcugcccuccuacagcgggcggaacucccacaacguccaccucgcgccggccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcgcucuga

SEQ ID NO: 10538 - RNA, 1611 nt, Artificial Sequence; identical to SEQ ID NO: 10521
  derived and/or modified sequence opt1 from capsid_protein__Norovirus__ADE28701

SEQ ID NO: 10539 - RNA, 1644 nt, Artificial Sequence
  derived and/or modified sequence opt1 from capsid_protein__Norovirus__ADE28721
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguaccccgaccccaacgagggcaucguggugcagccgcagaacggccgcugcacccuggacgggacccuccagggcacgacccagcugguccccacccagaucugcgccuuccgggggacccugaucggccagacgucccgcagcuccgacagcaccgacuccgcgccccggcgccgggaccacccgcuccacgugcagcugaagaaccuggacggcacccaguacgaccccaccgacgagguccccgccgugcucggggccaucgacuucaagggcacgguguucggggucgccagccagcgcgacguguccggccagcaggucggggccacccgggcccacgaggugcacaucaacaccaccgacccccgcuacacgccgaagcugggcagcauccugaugcacagcgaguccgacgacuucgugaccggccagcccgugcgguucacccccaucgggaugggcgacaacgacuggcaccagugggagcuccccgacuacagcgggcaccugacccugaacaugucccucgccccggcggucgcccccgccuuccccggcgagcgcauccuguucuuccgcagcaucgugcccuccgccgggggcuacggcagcggguacaucgacugccugaucccgcaggagugggugcagcacuucuaccaggaggcggcccccucccagagcgccgucgcccucauccgguacgugaaccccgacacgggccgcaacaucuucgaggccaagcugcaccgggagggguucaucaccguggcgaacuccggcaacaaccccaucgucgugccgcccaacggguacuuccgcuucgaggccugggugaaccaguucuacacccugacccccaugggcacgggccaggggcggcgccggaaccaguga

SEQ ID NO: 10540 - RNA, 1644 nt, Artificial Sequence
  derived and/or modified sequence opt1 from capsid_protein__Norovirus__ADE28722
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacauguucuacaccgaccccaacgagggcaucguggugcacccccagaacggccgcugcacccuggacgggacgcugcagggcaccacccagcucgucccgacccagaucugcgccuuccgggggacgcugaucggccagaccucccgcagcuccgacagcaccgacuccgcgccccggcgccgggaccacccccugcacgugcagcucaagaaccuggacggcacccaguacgacccgacggacgagguccccgccgugcugggggccaucgacuucaagggcaccguguucggggucgccagccagcgcgacguguccggccagcaggucggggccacccgggcccacgaggugcacaucaacaccacggacccccgcuacacccccaagcucggcagcauccugaugcacagcgaguccgacgacuucgugaccggccagccggugcgguucacccccaucgggaugggcgacaacgacuggcaccagugggagcugcccgacuacagcgggcaccucacgcugaacaugaaccuggcccccgcggucgccccggccuuccccggcgagcgcauccucuucuuccgcuccaucgugcccagcgccgggggcuacggcuccggguacaucgacugccugaucccccaggagugggugcagcacuucuaccaggaggcggccccgagccaguccgccgucgcccugauccgguacgugaaccccgacaccggccgcaacaucuucgaggccaagcuccaccgggagggguucaucaccguggcgaacagcggcaacaaccccaucgucgugcccccgaacggguacuuccgcuucgaggccugggugaaccaguucuacacccugacgcccaugggcaccggccaggggcggcgccggaaccaguga

SEQ ID NO: 10541 - RNA, 1644 nt, Artificial Sequence
  derived and/or modified sequence opt1 from capsid_protein__Norovirus__ADE28723
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaucucccgcagcuccgacagcaccgacuccgcgccccggcgccgggaccacccccuccacgugcagcugaagaaccuggacggcacccaguacgacccgaccgacgagguccccgccgugcucggggccaucgacuucaagggcacgguguucggggucgccagccagcgcgacguguccggccagcaggucggggccacccgggcccacgaggugcacaucaacaccaccgacccccgcuacacgcccaagcugggcagcauccugaugcacagcgaguccgacgacuucgugaccggccagccggugcgguucacccccaucgggaugggcgacaacgacuggcaccagugggagcuccccgacuacagcgggcaccugacccugaacaugaaccucgcccccgcggucgccccggccuuccccggcgagcgcauccuguucuuccgcuccaucgugcccagcgccgggggcuacggcuccggguacaucgacugccugaucccccaggagugggugcagcacuucuaccaggaggcggccccgagccaguccgccgucgcccucauccgguacgugaaccccgacacgggccgcaacaucuucgaggccaagcugcaccgggagggguucaucaccguggcgaacagcggcaacaaccccaucgucgugcccccgaacggguacuuccgcuucgaggccugggugaaccaguucuacacccugacccccaugggcacgggccaggggcggcgccggaaccaguga

SEQ ID NO: 10542 - RNA, 1644 nt, Artificial Sequence
  derived and/or modified sequence opt1 from capsid_protein__Norovirus__ADE28724
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucaacaccacggacccccgcuacacccccaagcugggcagcauccugaugcacagcgaguccgacgacuucgugaccggccagccggugcgguucacccccaucgggaugggcgacaacgacuggcaccagugggagcuccccgacuacagcgggcaccugacgcugaacaugaaccucgcccccgcggucgccccggccuuccccggcgagcgcauccuguucuuccgcuccaucgugcccagcgccgggggcuacggcuccgacuacaucgacugccugaucccccaggagugggugcagcacuucuaccaggaggcggccccgagccaguccgccgucgcccucauccgguacgugaaccccgacaccgggcgcaacaucuucgaggccaagcugcaccgggagggcuucaucaccguggcgaacagcgggaacaaccccaucgucgugcccccgaacggcuacuuccgcuucgaggccugggugaaccaguucuacacccuggcccccauggggacgggccagggccggcgccggaaccaguga

SEQ ID NO: 10543 - RNA, 1647 nt, Artificial Sequence
  derived and/or modified sequence opt1 from capsid_protein__Norovirus__ADK23787
augaagauggccagcaacgacgccacccccuccaacgacggcgcggccgggcuggugccggagaucagcaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucuccgccgcgcagaucaccaugugcccccacgugaucguggacguccgccagcuggagcccgugaaccugcccaugcccgacgugcggaacaacuucuuccacuacaaccagggcagcgacucccgccuccggcuggucgccaugcuguacaccccgcuccgcgccaacaacagcggcgacgacguguucacgguguccugccggguccugacccgccccagccccgacuucuccuucaacuuccuggugcccccgaccguggagagcaagaccaagcccuucacgcuccccauccugaccaucuccgagaugagcaacucccgguuccccgucccgaucgacagccugcacaccucccccaccgagaacguggugguccagugccagaacgggcgcgugacgcucgacggcgagcugauggggaccacccagcugcuccccagccagaucugcgccuuccggggcgugcugacccgcuccacgagccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaaggucuucggcguggccucccagcgcaaccccgacagcaccacccgggcccacgaggcgaagaucgacaccacggccgggcgcuucacccccaagcucggcucccuggagaucagcaccgaguccggcgacuucgaccagaaccagccgacccgguucacgcccgucgggaucggcguggaccacgaggccgacuuccagcaguggagccugcccgacuacuccgggcaguucacccacaacaugaaccucgcccccgcgguggccccgaacuuccccggcgagcagcugcuguucuuccgcagccagcuccccuccagcgggggccgguccaacggcauccuggacugccuggucccccaggagugggugcagcacuucuaccaggagagcgccccggcccagacccagguggcccucguccgcuacgugaaccccgacaccgggcgcgugcuguucgaggcgaagcugcacaagcucggcuucaugacgaucgccaagaacggggacucccccaucaccgugcccccgaacggcuacuuccgguucgagagcugggugaaccccuucuacacccuggcccccauggggaccggcaacggccgccggcgcauccaguga

SEQ ID NO: 10544 - RNA, 1623 nt, Artificial Sequence
  derived and/or modified sequence opt1 from capsid_protein__Norovirus__ADM52743
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgggcccucuga

SEQ ID NO: 10545 - RNA, 1623 nt, Artificial Sequence
  derived and/or modified sequence opt1 from capsid_protein__Norovirus__ADR57234
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgacgacguguucaccguguccugccgcguccucacccggccgagccccgacuucgacuucaucuuccuggugccgcccaccguggagucccgcacgaagcccuucagcguccccauccugaccguggaggagaugaccaacucccgguuccccaucccccucgagaagcuguucaccggcccgagcuccgccuucgugguccagccccagaacgggcgcugcacgaccgacggcgugcugcucgggaccacccagcugagccccgucaacaucugcacguuccggggcgacgugacccacaucaccggcucccacaacuacaccaugaaccuggccagccagaacuggaacuccuacgacccgacggaggagauccccgcgccccucgggacccccgacuucgugggcaagauccaggggguccugacccagaccacgcgcgccgacggcagcacccgggggcaccgcgccaccguguacaccggcagcgccgaguucgccccgaagcugggccgggugcaguucgccacggacaccgagaacgacuucgacaccaaccagaacaccaaguucacgcccgucggggugauccaggacggcaacaccacccaccgcaacgagccccagcagugggugcuccccuccuacagcgggcggaacucccacaacguccaccuggccccggcgguggcccccaccuuccccggcgagcagcuccuguucuuccgcagcacgaugcccgggugcuccggcuacccgaaccuggaccuggacugccuccugccccaggagugggugcagcacuucuaccaggaggccgcccccgcgcagagcgacgucgcccugcuccgguucgugaaccccgacaccggccgcgugcuguucgagugcaagcugcacaaguccggguacgucaccguggcccacaccggccagcacgaccucgugaucccgcccaacggguacuuccgguucgacagcugggucaaccaguucuacacccuggcccccaugggcaacgggacgggccgccgccgggcccuguga

SEQ ID NO: 10546 - RNA, 1626 nt, Artificial Sequence
  derived and/or modified sequence opt1 from capsid_protein__Norovirus__AEA07712
augcgcaugagcgacggcgccgcccccaaggcguccgggagcgaggccuccggccaggaccuggugccgagcgccgucgagcaggccgugcccauccagcccguggucggggccacccucgcggcccccgccgccggccagaucaaccagaucgacccguggaucuuccagaacuucgugcagugcccccugggggaguucuccaucagcccccggaacacccccggcgagauccuguucgaccucgcgcugggcccggggcugaaccccuaccucgcccaccuguccgccauguacacgggcuggguggggaacauggagguccagcuggugcucgccggcaacgccuucaccgcggggaagguggucguggcccuggugccgcccuacuuccccaagggcagcaucaccaccgcccagaucacgugcuucccccacgucaugugcgacgugcgcacccuggagcccauccagcucccccugcuggacgugcggcgcguccucuggcacgccacccaggaccaggaggaguccaugcggcuggugugcaugcuguacaccccgcuccgcacgaacagccccggcgacgaguccuucguggucagcgggcggcugcuguccaagcccgccgcggacuucaacuucguguaccucacgcccccgaucgagcgcaccaucuaccggaugguggaccugcccguccugcagccccgccucugcacccacgcccgguggcccgccccgguguacggccugcugguggaccccagccuccccuccaacccccaguggcagaacgggcgcguccacguggacggcacccugcugggcaccaccccggucagcggguccugggugagcugcuucgccgccgaggcggccuacgaguuccaguccggcaucggggagguggccaccuucacgcucaucgagcaggacggcagcgccuaccugcccggggaccgggccgcgccccugggcuacccggacuucagcggccagcucgagaucgagguccagaccgagaccaccaaggccggggacaagcugaaggugacgaccuucgagauggcccugggccccaccaccaacguggaccaggcccccuaccaggggcgcgucuucgcguccuucacggccagcgccucccucgaccugguggacggccgggugcgcgccgucccccggagcaucuucggguuccaggacguggugccggaguacaacgacggccugcucgucccccuggccccgcccaucggccccuuccugcccggggaggugcuccugcgcuuccggaccuacaugcgccagaucgacuccagcgacgcggccgccgaggccaucgacugcgcccugccccaggaguucguguccugguucgcgagcaacggcuucaccguccaguccgacgcccuccugcugcgguaccgcaacacccucacggggcagcugcuguucgagugcaagcuguacagcgacggcuacaucgcccucuccuacagcggguccggcccccugaccuucccgaccgacggcuucuucgagguggugagcugggucccccgccuguaccagcucgccuccguggggagccuggccaccggccggacgcugaagcaguga

SEQ ID NO: 10547 - RNA, 1623 nt, Artificial Sequence
  derived and/or modified sequence opt1 from capsid_protein__Norovirus__AEK05311
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucgcggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaccgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgcgaugcucuacacgccccugcgggccaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcggggccuucgugguccagccgcagaacggccgcugcaccacggacggggugcugcugggcaccacccagcucucccccgucaacaucugcaccuuccggggcgacgugacgcacaucgccgggagccgcaacuacaccaugaaccuggcgucccugaacuggaacaacuacgaccccaccgaggagaucccggcgccccucggcacccccgacuucguggggaagauccagggcguccugacgcagaccaccaagggggacggcagcacccggggccacaaggccacgguguacaccggguccgcccccuucaccccgaagcugggcagcgugcaguucagcaccgacacggagaacgacuucgagacccaccagaacaccaaguucgcccccgucggggugauccaggacggcuccaccacgcaccgcaacgagccccagcagugggugcuccccagcuacuccgggggcaacguccacaacgugcaccuggccccggccguggcccccaccuuccccggcgagcagcuccucuucuuccggagcaccaugcccgggugcuccggcuacccgaacauggaccuggacugccugcucccccaggaguggguccagcacuucuaccaggaggccgcgcccgcccagagcgacguggcccugcugcgcuucgugaaccccgacaccgggcggguccucuucgagugcaagcugcacaaguccggcuacgugacgguggcccacaccgggcagcacgaccuggucaucccgcccaacggcuacuuccgcuucgacagcugggugaaccaguucuacacccucgcccccaugggcaacgggaccggccggcgccgggcgcuguga

SEQ ID NO: 10548 - RNA, 1608 nt, Artificial Sequence
  derived and/or modified sequence opt1 from capsid_protein__Norovirus__AEP16505
augaagauggccagcuccgacgccgcgcccagcaacgacggcgccgccgggcuggugccggaggucaacaacgagaccauggcccucgagcccguggccggcgcguccaucgccgcgccccugaccgggcagaacaacgugaucgaccccuggauccgcaugaacuucguccaggccccgaacggcgaguucacggugagcccccggaacucccccggggaggugcugcucaaccuggagcugggccccgagcucaacccguuccuggcccaccugagccgcauguacaacggcuacgccgggggcgucgagguccaggugcuccuggccgggaacgccuucaccgccggcaagcugguguucgcggccaucccgccccacuucccccucgagaaccugucccccgggcagaucaccauguucccccacgugaucaucgacgugcggacccuggagcccguccuccugccccugccggacgugcgcaacaacuucuuccacuacaaccagcagcccgagccccggaugcgccucguggccaugcuguacacgccccugcggagcaacggcuccggcgacgacgucuucaccgugagcugccgcgugcucacccggccgucccccgacuucgacuucaacuaccuggucccgcccaccguggagagcaagacgaagcccuucacccugcccauccucaccaucggggagcuguccaacagccgcuuccccgugcccaucgacgagcuguacaccuccccgaacgagggcgucguggugcagccccagaacgggcggagcacgcucgacggcgagcugcugggcaccacccagcucguccccuccaacaucugcgcccugcgcgggcggaucaacgcccaggugccggacgaccaccaccaguggaaccugcaggucaccaacgcgaacggcacgagcuucgaccccaccgaggacgugcccgcgccccucgggaccccggacuuccuggccaacaucuacggcgugaccucccagcgcaaccccgacaacacgugccgggcccacgacgggguccuggccaccuggagccccaaguucacccccaagcucggcagcguggugcugggcaccugggaggaguccgaccuggaccucaaccagccgacgcgcuucacccccgucgggcuguacgacaccaaccacuucgaccaguggauccugcccaacuacagcggccggcucacccugaacaugaaccuggcccccuccguggccccgcuguuccccggggagcagauccucuucuuccgcagccacaucccccugaagggcgggacguccaacggcgccaucgacugccuccugccccaggaguggauccagcacuucuaccaggagagcgccccgucccccaccgacguggcccugauccgguaccccaaccccgacaccggccgcguccuguucgaggcgaagcuccugcggccgggguucaucaccguggccaacuucggcuucaagcccaucguggucccgcccaagggguacuuccgcuucgacagcugggugaaccaguucuacucccuggcccccaugggcacggggaacggccgccggcgcgugcaguga

SEQ ID NO: 10549 - RNA, 1632 nt, Artificial Sequence
  derived and/or modified sequence opt1 from capsid_protein__Norovirus__AEY77318
augaugauggccagcaaggacgcccccaccaacauggacggcaccuccggggcgggccagcuggugccggaggucagcacggccgagcccaucuccauggagcccguggccggggccgccaccgcggccgccaccgccggccaggugaacaugaucgaccccuggaucaugagcaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcgugccgcccggguucgcggcccagaacgugagcaucgcccaggccaccauguucccccacgucaucgccgacgugcgggugcuggagcccaucgaggucccccucgaggacgugcgcaacgugcuguuccacaacaacgacuccacccccacgaugcggcugaucugcaugcucuacacgccccugcgcgcgagcggcuccagcuccggcaccgacccguucgucaucgccgggcgggugcugaccugccccagccccgacuucaacuuccucuuccuggugcccccgaacgucgagcagaagaccaagcccuucuccgugcccaaccugccccucaacgugcugagcaacucccgcgucccgagccugaucaaguccaugauggugagccaggaccacggccagauggugcaguuccagaacgggcgggucacccucgacggccagcugcagggcaccacccccacgagcgccucccagcugugcaagauccgcgggaccguguaccacgccaccggcgggcagggccucaaccugaccgagaucgacgggacgcccuaccacgccuucgagagccccgcgccgaucggcuuccccgaccugggcgagugcgacuggcacaucaacgccucccccgccaacgccuucaccgacgggagcaucauccaccggaucgacgucgcccaggacuccaccuucgcgccgcaccucggcaccauccacuacacgaacgccgacuacaacgccaacguggggcugaucugcagccuggaguggcucuccccgcccagcggcggggcccccaaggugaaccccugggcgaucccccgcuacggcuccacccugaccgaggccgcccagcuggccccgcccaucuacccgcccggcuucggggaggccaucgucuucuucaugagcgacuuccccaucgcgaacggcuccgacgggcucagcgugcccugcaccaucccccaggaguucgugacgcacuucgucaacgagcaggcccccacccggggcgaggccgcccugcugcacuacguggaccccgacacccaccgcaaccucggggaguucaagcuguaccccgagggcuucaugaccugcgugccgaacuccagcggcuccgggccccagacgcugcccaucaacggcgucuucaccuucaucagcugggugucccgguucuaccagcucaagcccguggggaccaccggcccgguccgccggcugggcauccgccggagcuga

SEQ ID NO: 10550 - RNA, 1626 nt, Artificial Sequence
  derived and/or modified sequence opt1 from capsid_protein__Norovirus__AEY83583
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgcccccgacuucaacuucgucuaccugaccccgcccaucgagcgcaccaucuaccggaugguggaccugcccgugcuccagccccgccugugcacccacgcccgguggccggcccccgucuacggccugcucguggaccccagccugcccuccaacccgcaguggcagaacgggcgcgugcaggucgacggcacgcugcucggcaccacccccgugagcggguccugggucagcugcuucgccgcggaggccgccuacgaguuccaggccggcaccggggagguggugacguucaccaugaucgagcaggacggcuccgccuacguccccggggaccgggcggccccgcugggcuaccccgacuucagcggccagcuggagaucgaggugcagaccgagaccacgaagaccggggacaagcuccgcgugaccaccuucgagaugauccugggccccacgaccaacgucgaccaggcccccuaccaggggcgggccuacgcgucccugaccgccgccgccagccucgaccugguggacggccgcgugcgggccgucccgcgcagcaucuacuccuuccaggacgagcugcccgaguacaacgacggggugcucgugccccuggcgcccccgcugggccccuuccuccccggcgagguccugcugcgguuccgcaccuacaugcggcagcucgacacggccgacgccgccgcccagcccaucgacugcgcgcugccgcaggaguucaucagcugguucgccuccaacaacuucaccgugcagagcgacgcccugcucgugcgcuaccgcaacacccugaccgggcagcugcuguucgaggccaagcucuacuccgagggcuacaucgccgucagcuacuccgggagcggcccccugacguuccccaccgacggguucuucgaggugguguccugggucccccggcuguuccagcucgcgagcgugggcucccuggugaccggccgcacccugaagcaguga

SEQ ID NO: 10551 - RNA, 1629 nt, Artificial Sequence
  derived and/or modified sequence opt1 from capsid_protein__Norovirus__AFB18010
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcaccaacuucguccaggcgccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucacgauguucccccacgugaucaucgacguccggacccucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguucaagaccaagcccuucacgcugcccauccucacccugggcgagauguccaacagccgguuccccguccccaucgaccagauguacaccucccccaacgagaucaucagcgugcagugccagaacgggcgcugcacccuggacggcgagcuccaggggacgacccagcuccagguguccggcaucugcgccuucaagggccaggucaccgcccaccuccaggacaacgagcaccuguacaacgugaccaucacgaaccugaacgggagcccguucgaccccuccgaggacauccccgccccgcugggcguccccgacuucgaggggcggguguucggcgugaucagccagcgcgacaacuacaacuccgggggccagaaccagcccgccaaccggagccacgacgcggucgugcccaccuacaccgcccaguacaccccgaagcucggccagauccagaucgggacguggcagaccgacgacaucaccguggaccagcccgccaaguucacccccgucggccuguccgacacggaccacagcaaccaguggguggugccccgcuacgccggggcccugaaccucaacaccaaccuggcgccgagcgucgcccccguguuccccggcgagcggcugcuguucuuccgcuccuacaucccccugaagggcggguucggcaacccggccaucgacugccuggugccccaggaguggauccagcacuucuaccaggaggccgcgcccagccucuccgaggucgcccuggcccgguacaucaaccccgacaccgggcgcgcccuguucgaggccaagcuccaccgggcgggcuucaugaccgugagcuccaacacgagcgccccgguggucgugcccgccaacggguacuuccgcuucgacuccugggugaaccaguucuacagccuggcccccaugggcaccgggaacggccggcgccgcauccaguga

SEQ ID NO: 10552 - RNA, 1623 nt, Artificial Sequence
  derived and/or modified sequence opt1 from capsid_protein__Norovirus__AFB18013
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgaggacgucuucaccguguccugccgcgugcugacccggccgagccccgacuucgacuucaucuuccucgucccgcccaccguggagucccgcacgaagcccuucaccgugcccauccugaccgucgaggagaugaccaacagccgguuccccaucccccuggagaagcuguucacgggcccguccggggccuucgugguccagccccagaacggccgcugcaccaccgacggggugcuccugggcaccacgcagcucagccccgugaacaucugcaccuuccggggcgacgucacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccguguccacgggggacguccacuucaccccgaagcugggcagcauccaguucaacaccgacaccaacaacgacuucgagacggggcagaacaccaaguucacccccgugggcgugguccaggacgggaacggcacccaccagaacgagccccagcagugggugcugcccuccuacagcggccggacggggcacaacgugcaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacguggcccuccugcgguucgucaaccccgacaccgggcgcgugcuguucgagugcaagcuccacaaguccggcuacgugaccgucgcccacacgggccagcacgaccuggugaucccgcccaacggguacuuccgguucgacagcugggugaaccaguucuacacccuggcgcccaugggcaacgggaccggccgccggcgcgcccucuga

SEQ ID NO: 10553 - RNA, 1743 nt, Artificial Sequence
  derived and/or modified sequence opt1 from capsid_protein__Norovirus__AFJ05624
augaagauggccagcaacgacgccaccgcgcccucccaggacggcgccgccaaccuggugccggagagccagcacgagguccucgcccuggagcccguggccggggcggcccuggccgcccccguggcgggccaguucaacgccaucgaccccuggaucaagcagaacuucguccaggccccggccggggaguucaccgugagcccccgcaacgcccccggcgagauccucauggaccuggagcuggggcccgagcucaacccguuccuggcgcaccuggcccagauguacaacgccuacgccggcggcauggaggugcagaucauccucgccgggaacgcguucacggccggcaagaucaucgucugcgccgugccgcccaacuucccgcccgaccggcuguccgccucccaggccaccaacuucccccacgugaucauggacguccgcacccuggagcccgugauccucccccugcccgacgugcgggcgggguucuuccacuacaaccagcugcgcgagccccggaugcgccucauggcccugcuguacacgccccuccgggccaacggcaccggggacgacgccuucaccgucagcugccgcgugcugacccggcccaugcaggacuucgaguucauguuccuggugccgcccaccgucgagucccgcgugacgcccuucagcgugcccaccuacccggucguggagaugaccaacucccgguggcccgcccgcaucagcggcaugcacgugaacgcgaaccagacccucgccguccaguuccagaacggccggugcacgcuggacgggcagcugaugggcaccacccagcucugcgccgccgacgugugccgcaugcgggggcgcuacaccuccacgcgggcggaccuggccggcguggaccacaccgaccagggccccagccuggggaccggccccuccgacgacagcgucuccgugccggaggcccgcgcccagacccggacgggggucagcgcccaccuccagcuggaggagcugaacggccagcccuacgagguguacggggagcagcccgcgccgcucggcacccccgacuuccgcugccggcugaugggcgagcuggugcgccuccccuccaccagccccgccgcccagucccgcuuccgggacgccuucuucgacaccuacggggcccuguucgcgccggccgucggcagcacgaccuucaccgugaacaacagcuccaccagcgacuucgccaacgggcagcccuucgaguuccugcccaucggcguggagaucgggaacuccgcccaguacgacgaguucgcccuccccagcuacaacggcgcgaucggcgagaaccgccaccuggccccggucgccgcccccggguuccccggcgagaacaucguguucuucuccagcaaccugcccgugugggacuccacgagcgcgcagaacaaccggcgcaucuccugccuccugccgaacgaguucguccagcacuucuacgaccugcaggcccccagccaguccgacguggcccuccugcgguacgugcaccccgagagcgggcgcguccuguucgagugcaagcucuaccgggacggcuuccugaccgugaacggggccucccuggccgaguuccccgugaacggcuacuuccgcuucgacagcugggucaaccaguucuucacccucuccccggugggcaccgggagcggccggcgcgggcggucccgcaacgcgcaguga

SEQ ID NO: 10554 - RNA, 1746 nt, Artificial Sequence
  derived and/or modified sequence opt1 from capsid_protein__Norovirus__AFJ05628
augaagauggccagcaacgacgccgcgucccccagcuccgacggcgccgccaaccuggugccggagaucaacaacgaggucauggcccucgagcccguggccggggcgcagcuggccgcccccguggccggccaguucaacgcgaucgaccccuggauccgccagaacuucguccaggccccggagggggaguucaccgugagcccccggaacgcccccggcgagauccugcucaaccuggagcuggggccccaccucaacccguuccugcagcaccuggcccagauguacaacgccuacgcgggcggcauggaggugcaggucgugcucgccgggaacgccuucaccgccggcaagaucaucuucgccgcggugccgccccacuucccgcccgagcgccuguccgccgcccaggccacgcaguucccccacgucaucguggacgugcggcagcuggagcccaucauccucccccugccggacguccgccacaaccuguuccacuucaaccagcagaacgacgagcggaugcaccucguggccuuccuguacacgccccugcgcgcgaacagcggguccggcgacgacguguucaccgucagcugccgggugcucacccgccccucccaggacuucgaguucauguuccuggugcccccgaccgucgagaagaagaccguggccuucagccugccccagcucgccaucggggagauguccaacagccgguggcccgcccgcaucaccggccugguggucgacccccggcugccccaggugcuccacauccagaacggccgcugcacccuggacgggacgcugaugggcaccacccagcucaaccccaacgacaucugccggauccgcggguacuucuccagcucccggcccgagcugcugugcgagaacgaggagagcgccaccgaccccaugccgacggagaccgacaccgacaaccagccgcccgaggugcgcgcgcaggcccgggccacccagcgcugguucgccgucacggagcucaacggccagguguacgaccccuucggcgaccagcccgcgccccuggggguccccgacuucaaggcccggauccugggcgcccucaugcgccugccggggaccaaccccaccuccaacagccgguucgaggacgccuggguggagaccaacaaccagacgaccuacgcccccgcggccggcguggucgccaucaccaccaacgacaacuccagcagcaacuacgccaacgaccagacgugcgaguucgugccccuggggaucgagaucaccgacuccgccccguaccacgaguucgaccuccccagcuacggcggcgcggccuccagcgggaaccgcaaccuggcccccaccguggcccccaccuucccgggcgaggccauccuccucuucggguccaacaugcccgucuacaaccgcaacacgggcaccagcaacaaggacauccggugccugcugcccaacgaguacgugcagcaccucuacgacacccaggcgcccucccugagcgacguggcccugguccgcuacgugaaccgggacaccgggcgcgugcuguucgaggccaagcugcaccgggacggcuucaugacggucaacgccuccagcaccaccgugcugccgguggacggcuacuuccgcuucgacuccugggucaaccaguucuacgcgcucagccccguggggaacgccuccggccggcgcgggcggagccgccagaccaacuga

SEQ ID NO: 10555 - RNA, 1623 nt, Artificial Sequence
  derived and/or modified sequence opt1 from capsid_protein__Norovirus__AFJ24945
augaagauggccagcaacgacgccaaccccuccgacggcagcgcggccucccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggcgggaacguccacaacgugcaccuggccccggccguggcgcccaccuuccccggcgagcagcuccucuucuuccggagcacgaugcccggcugcuccggguacccgaacauggaccuggacugccugcucccccaggaguggguccagcacuucuaccaggaggccgcccccgcccagagcgacguggcgcugcugcgcuucgugaaccccgacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgggcccuguga

SEQ ID NO: 10556 - RNA, 1638 nt, Artificial Sequence
  derived and/or modified sequence opt1 from capsid_protein__Norovirus__AFK75851
augaugauggccagcaaggacgcgcccccgaacauggacggcaccuccggggccggccagcuggugcccgaggccaacaccgccgagcccaucagcauggagcccgucgccggggccgcgacggccgccgccaccgcgggccaggugaacaugaucgacccguggaucaugaacaacuacgugcaggcgccccagggggaguucaccaucucccccaacaacacccccggcgacauccucuucgaccugcagcugggcccgcaccucaaccccuuccugagccaccuggcccagauguacaacgggugggucggcaacaugaaggugaaggugcuccuggccgggaacgccuucacggccggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacacccccaccaugcgccuggucugcaugcucuacacgccgcugcgggccuccggcagcuccagcggcaccgaccccuucgugaucgccgggcgcgugcugaccugccccucccccgacuucagcuuccucuuccuggucccgcccaacguggagcagaagaccaagcccuucuccgugcccaaccugccgcucaacacgcugagcaacucccggguccccagccugauccgcuccaugauggugagccgggaccacggccagauggugcaguuccagaacgggcgcgucacccucgacggccagcugcagggcaccacccccacguccgccagccagcugugcaagauccgggggagcguguuccacgccaacggcgggaacggcuacaaccucaccgagcuggacgggucccccuaccacgcguucgagagcccggcccccaucggcuuccccgaccugggcgagugcgacuggcacauggaggccuccccgaccacccaguucgacacgggggacgugaucaagcagaucaacgucaagcaggaggccgccuucgcgccccaccucggcaccauccaggccgacgggcugagcgacguguccgucaacaccaacaugaucgccaagcugggcugggugagccccguguccgacgggcaccgcggcagcgucgaccccugggugaucccgcgguacggcuccacccucacggaggccgcgcagcuggccccgcccaucuacccgcccggguucggcgaggccaucguguucuucaugagcgacuuccccaucgcccacggggccaacggccuguccguccccugcaccaucccccaggaguucgugacccacuucgugaacgagcaggcgcccacccgcggggaggccgcccuccugcacuaccuggaccccgacacgcaccggaaccucggcgaguucaagcuguaccccgagggcuucaugaccugcguccccaacagcuccgggaccggcccgcagacccugcccaucaacgggguguucgccuucgugagcugggucucccgcuucuaccagcucaagcccgugggcacggccggccccgcgcggcgccuggggauccggcgcagcuga

SEQ ID NO: 10557 - RNA, 1635 nt, Artificial Sequence
  derived and/or modified sequence opt1 from capsid_protein__Norovirus__AFK75852
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgagaugagcaagauccccaacagcuccacgcagagcaaccccaucguggugaacuccgucaagccgaacagccagcaguucgugccccaccucuccagcaucacccuggacgacaacguguccagcggcggggacuacaucggcaccauccaguggaccuccccgcccagcgacuccgggggcgccaacacgaacuucuggaagauccccgacuacggcagcucccuggccgaggcgagccagcucgcccccgccgucuacccgcccggguucaacgaggugaucguguacuucauggccuccauccccggccccaaccagagcgggucccccaaccugguccccugccugcucccgcaggaguacaucacccacuucaucagcgagcaggcccccauccagggcgaggcggcccugcugcacuacguggaccccgacaccaaccggaaccucggggaguucaagcuguaccccggcggcuaccugaccugcgugccgaacuccagcagcacggggccccagcagcucccccuggacggcgucuucguguucgccuccugggugagccgcuucuaccagcugaagcccgucgggaccgccggcccggcgcggggccgccucggggugcggcgcuga

SEQ ID NO: 10558 - RNA, 1641 nt, Artificial Sequence
  derived and/or modified sequence opt1 from capsid_protein__Norovirus__AFK75853
augaugauggccagcaaggacgccucccagagcgcggacggcgccuccggggccggccagcuggugcccgaggucaacaccgccgacccgcuccccauggagcccguggccgggcccaccacggcgguggccaccgccggccaggucaacaugaucgacccguggaucgugaacaacuucgugcagagcccccagggggaguucaccaucucccccaacaacacccccggcgacauccuguucgaccugcagcucggcccgcaccugaaccccuuccugagccaccucucccagauguacaacgggugggucggcaacaugcgcgugcggauccugcuggccgggaacgcguucagcgccggcaagaucaucgugugcugcgucccgcccggguucacguccagcucccucaccaucgcccaggccacccuguucccccacgugaucgccgacgugcgcacccuggagcccaucgagaugccccucgaggacguccggaacgugcuguaccacacgaacgacaaccagcccaccaugcgccuggugugcaugcucuacaccccgcugcggaccggcggcgggagcggcaacuccgacagcuucgucguggcggggcgcgugcugacggcccccuccagcgacuucuccuuccucuuccuggucccgcccaccaucgagcagaagacccgggccuucaccgugcccaacaucccccugcagacgcucagcaacucccgcuuccccagccugauccagggcaugauccugagccccgacgccucccaggugguccaguuccagaacggccggugccucaucgacgggcagcugcugggcaccaccccggccaccagcgggcagcuguuccgcgugcggggcaagaucaaccagggggcgcgcacgcucaaccugaccgagguggacggcaagcccuucauggccuucgacucccccgcccccgucggcuucccggacuucgggaagugcgacuggcacaugcggaucagcaagacccccaacaacaccuccagcggcgaccccaugcgcuccgugagcguccagacgaacgugcagggguucgugccgcaccucggcuccauccaguucgacgaggucuucaaccaccccaccggggacuacaucggcaccaucgaguggaucagccagcccuccacgcccccgggcaccgacaucaaccugugggagauccccgacuacgggagcucccugagccaggccgccaaccucgcgccgcccguguucccgcccggcuucggggaggcccugguguacuucgucuccgccuuccccggccccaacaaccggagcgcccccaacgacgugcccugccugcucccccaggaguacaucacccacuucguguccgagcaggcccccaccaugggggacgcggcccugcugcacuacgucgacccggacaccaaccgcaaccucggcgaguucaagcuguaccccggcggguaccugacgugcgugcccaacggcgugggggccggcccccagcagcucccgcugaacggcgucuuccuguucgugagcugggugucccgguucuaccagcucaagcccgucgggaccgccagcaccgcgcgcggccggcugggggugcgccggaucuga

SEQ ID NO: 10559 - RNA, 1647 nt, Artificial Sequence
  derived and/or modified sequence opt1 from capsid_protein__Norovirus__AFK75854
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaccuucuuccacuacaaccaggacuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcuguucacgcugcccauccugaccaucagcgagauguccaacagccgguuccccgugcccaucgacucccuccacaccagcccgaccgagaacaucgucgugcagugccagaacggccgcgugacgcuggacggggagcugaugggcaccacccagcuccugcccucccagaucugcgccuuccgggggacccugacgcgcagcaccucccgggcgagcgaccaggccgacacccccacgccccgccucuucaaccaccgguggcacauccagcuggacaaccugaacggcaccccguacgaccccgccgaggacauccccgccccgcucggcacccccgacuuccgcgggaaggucuucggcguggccagccagcggaaccccgacuccaccacccgcgcgcacgaggccaagguggacacgaccagcgggcgguucacccccaagcugggcucccuggagaucaccacggagagcgacgacuucgacaccaaccaguccaccaaguucaccccggucgggaucggcguggacaacgaggccgaguuccagcaguggagccuccccaacuacuccggccaguucacgcacaacaugaaccuggcccccgcggucgcccccaacuucccgggggagcagcuccucuucuuccgcagccagcugcccuccagcggcgggugguccaacggcgugcuggacugccucgugccccaggaguggguccagcacuucuaccaggagagcgcccccgcccagacccagguggcccuggugcgguacgucaacccggacaccgggcgcgugcuguucgaggcgaagcuccacaagcugggcuucaugaccaucgccaagaacggcgacucccccaucacggugccgcccaacggguacuuccgcuucgagagcugggucaaccccuucuacacccuggcccccaugggcaccgggaacggccggcgccggauccaguga

SEQ ID NO: 10560 - RNA, 1671 nt, Artificial Sequence
  derived and/or modified sequence opt1 from capsid_protein__Norovirus__AFN61315
augaagauggccagcuccgacgccgcgcccagcgccgacggcgccgggaaccuggugccggagucccagcaggagguccucccccuggcccccguggccggcgcggcccuggccgcccccguggucgggcagaccaacaucaucgacccguggaucaaggagaacuucgugcaggcgccccagggcgaguucaccgugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucacggccgggaaggugcugaucgcggccaucccgcccaacuuccccguggagggcgucagcgccucccaggccacccaguucccccacgugaucaucgacgugcggacccuggaccccguccgccucccccugccggacgugcggagcaccuucuuccacuacacgaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagaccaagacgacccccuucuccgugcccggguucagcguccaggagauguccaacagccgcuggccggcggccaucuccgccaugguggugcggggcaacgagccccaggucgugcaguuccagaacgggcgcgcccaccuggacggcaugcugcucggcaccacccccgucagccccaacuacaucgccagcuaccgggggaucuccacgggcaacagccgcuccgcgagcuccgaggccgacgagcgggccguggggagcuucgacguguggauccgccugcaggagccggacggccagcccuacgacaucuucgggaagcagcccgccccgaucggcacccccgacuucaaggccgucaucgugggcuucgcggcccggccccugaccuccgggagcuacgccaacgaggccuacgugaacaccacggcguccgacuacgcccccgccaccggcaacaugcgcuucaccguccggaacgggggcaccgggcacaucagcgccaacaaguacugggaguuccgcuccuucggcguggagggcgagcggcacacggacgugcaguaccaggaguacgagcucccggacuacagcgggcaggucgccuccaaccacaaccuggcgccgcccguggcgccccgcaugcccggcgagagccugcuccuguuccaguccaacaugcccgugugggacgacgggcggggcgagagcacccccaagaagauccacugccugcucccccaggaguucaucgggcacuucuucgacaagcaggccccgucccugggcgacgccgcccugcuccgcuacgucaaccaggagaccaaccgcgugcuguucgagugcaagcuguaccgggacggcuacaucaccguggccgccgccagcgggcuccuggacuucccccuggacggcuucuuccgcuucgacuccugggucagcagcuucuacauccucucccccguggggagcggccagggccggcgcgggcgggugcgcuuccaguga

SEQ ID NO: 10561 - RNA, 1623 nt, Artificial Sequence
  derived and/or modified sequence opt1 from capsid_protein__Norovirus__AFQ00511
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgugcuguga

SEQ ID NO: 10562 - RNA, 1623 nt, Artificial Sequence; identical to SEQ ID NO: 9441
  derived and/or modified sequence opt1 from capsid_protein__Norovirus__AFQ00512

SEQ ID NO: 10563 - RNA, 1623 nt, Artificial Sequence
  derived and/or modified sequence opt1 from capsid_protein__Norovirus__AFQ00513
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 10564 - RNA, 1623 nt, Artificial Sequence
  derived and/or modified sequence opt1 from capsid_protein__Norovirus__AFQ00516
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucggcacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggcgagcagcuccucuucuuccgcagcacgaugccggggugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 10565 - RNA, 1623 nt, Artificial Sequence; identical to SEQ ID NO: 9441
  derived and/or modified sequence opt1 from capsid_protein__Norovirus__AFQ00517

SEQ ID NO: 10566 - RNA, 1623 nt, Artificial Sequence; identical to SEQ ID NO: 10106
  derived and/or modified sequence opt1 from capsid_protein__Norovirus__AFQ00518

SEQ ID NO: 10567 - RNA, 1623 nt, Artificial Sequence
  derived and/or modified sequence opt1 from capsid_protein__Norovirus__AFQ00519
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccacccggggcgacggguccacgcgcggccacaaggccaccguguacaccggcagcgcccccuucaccccgaagauggggagcgugcaguucuccacggacaccgagaacgacuucgagacccaccagaacaccaaguucacgcccgucggcgugauccaggacgggggcaccacccaccggaacgagccccagcagugggugcugcccagcuacuccgggcgcaacgucccgaacgugcaccucgcccccgccguggcgcccaccuuccccggcgagcagcugcuguucuuccggagcacgaugccgggcugcuccggguaccccaacauggaccucgacugccugcugccccaggaguggguccagcacuucuaccaggaggccgcccccgcccagagcgacguggcgcuccugcgcuucgugaacccggacaccggccggguccuguucgagugcaagcuccacaaguccggguacgugaccguggcccacaccggccagcacgaccuggucaucccgcccaacggguacuuccgcuucgacagcugggugaaccaguucuacacccuggcccccaugggcaacggcacggggcggcgccgcgcccucuga

SEQ ID NO: 10568 - RNA, 1623 nt, Artificial Sequence
  derived and/or modified sequence opt1 from capsid_protein__Norovirus__AFQ00520
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagcccggcuacgugaccguggcccacaccgggcagcacgaccuggugaucccgcccaacggcuacuuccgguucgacagcugggucaaccaguucuacacccucgcccccauggggaacggcacgggccgccggcgcgcccuguga

SEQ ID NO: 10569 - RNA, 1623 nt, Artificial Sequence
  derived and/or modified sequence opt1 from capsid_protein__Norovirus__AFQ00521
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgugcuguga

SEQ ID NO: 10570 - RNA, 1623 nt, Artificial Sequence
  derived and/or modified sequence opt1 from capsid_protein__Norovirus__AFQ00522
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaagcccggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10571 - RNA, 1623 nt, Artificial Sequence; identical to SEQ ID NO: 10570
  derived and/or modified sequence opt1 from capsid_protein__Norovirus__AFQ00523

SEQ ID NO: 10572 - RNA, 1623 nt, Artificial Sequence; identical to SEQ ID NO: 10106
  derived and/or modified sequence opt1 from capsid_protein__Norovirus__AFQ00524

SEQ ID NO: 10573 - RNA, 1623 nt, Artificial Sequence; identical to SEQ ID NO: 10106
  derived and/or modified sequence opt1 from capsid_protein__Norovirus__AFQ00525

SEQ ID NO: 10574 - RNA, 1623 nt, Artificial Sequence
  derived and/or modified sequence opt1 from capsid_protein__Norovirus__AFQ00526
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccacaacuacgccaugaaccuggcgagccugaacuggaacaacuacgaccccaccgaggagaucccggcgccccucgggacccccgacuucgugggcaagauccaggggguccugacgcagaccaccaagggcgacggguccacccgcggccacaaggccacgaucuacaccggcagcgcccccuucaccccgaagcuggggagcgugcaguucuccaccgacacggagaacgacuucgagacccaccagaacaccaaguucacccccgugggcgucauccaggacgggggcacgacccaccggaacgagccccagcagugggugcuccccagcuacuccgggcgcaacgugccgaacguccaccuggcccccgccguggcccccaccuuccccggcgagcagcuccucuucuuccggagcaccaugccgggcugcuccggguaccccaacauggaccuggacugccugcucccccaggagugggugcagcacuucuaccaggaggccgcccccgcgcagagcgacgucgcccugcugcgcuucgugaacccggacacgggccggguccucuucgagugcaagcugcacaaguccggguaccugaccguggcccacaccggccagcacgaccucgugaucccgcccaacggguacuuccgcuucgacagcugggugaaccaguucuacacccuggcccccaugggcaacggcaccgggcggcgccgggcccuguga

SEQ ID NO: 10575 - RNA, 1623 nt, Artificial Sequence; identical to SEQ ID NO: 10106
  derived and/or modified sequence opt1 from capsid_protein__Norovirus__AFQ00527

SEQ ID NO: 10576 - RNA, 1623 nt, Artificial Sequence
  derived and/or modified sequence opt1 from capsid_protein__Norovirus__AFQ00528
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcggggccacaaggccaccguguacaccggcuccgccccguucacccccaagcuggggagcgugcaguucagcacggacaccgagaacgacuucgagacccaccagaacaccaaguucacgcccgucggcgugauccaggacgggggcaccacccaccgcaacgagccccagcagugggugcucccguccuacagcgggcgggacguccccaacgcccaccuggcccccgcgguggcccccaccuucccgggcgagcagcuccucuucuuccgcuccacgaugcccggcugcagcggguaccccaacauggaccuggacugccugcucccccaggagugggugcagcacuucuaccaggaggccgccccggcgcaguccgacgucgcccugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 10577 - RNA, 1644 nt, Artificial Sequence
  derived and/or modified sequence opt1 from capsid_protein__Norovirus__AGC66782
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaucggccgcugcacgcuggacggcucccuccaggggaccacccagcuggucccgacccagaucugcagcuucggcgggacgcugaucucccagaccagccgguccgccgacagcaccgacuccgcgccccgcgugcggaaccacccccuccacguccagcugaagaaccuggacggcaccccguacgaccccacggacgaggugcccgccgugcucggcgccaucgacuucaaggggaccgucuucggcguggccagccagcgcaacaccaccgggggcagcgugggggccacgcgggcccacgagguccacaucgacaccaccaacccccgcuacaccccgaagcugggcuccgcccugauguacagcgaguccgacgacuucgacgacggccagcccacgcgguucacccccaucgggaugggcgcggacgacuggcaccagugggagcuccccgaguacagcgggcaccugacccugaacaugaaccucgccccggccguggcccccgcguuccccggcgagcgcauccuguucuuccgguccgugguccccagcgccgggggcuacggcuccgggcagaucgacugccugaucccgcaggagugggugcagcacuucuaccaggaggccgcccccagccaguccgccguggcgcucauccgcuacgucaaccccgacaccggccgcaacauccuggaggccaagcugcaccgggagggguucaucacgguggccaacagcggcaacaaccccaucguggucccgcccaacggguacuuccgcuucgaggccugggugaaccaguucuacacccucacccccaugggcaccggccaggggcggcgccgggugcaguga

SEQ ID NO: 10578 - RNA, 1623 nt, Artificial Sequence
  derived and/or modified sequence opt1 from capsid_protein__Norovirus__AGC66784
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccagcgacuucgacuucaucuuccucgugccgcccaccguggagucccgcaccaagcccuucacgguccccauccugaccguggaggagaugaccaacagccgguucccgaucccccuggagaagcuguucaccggccccuccagcgccuucgugguccagccccagaacgggcgcugcacgaccgacggcgugcugcuggggaccacccagcucuccccggucaacacgugcaccuuccggggcgacgugacccacaucgccggcagccgcaacuacaccaugaaccuggccucccugaacuggaacaacuacgaccccacggaggagauccccgcgccgcucgggacccccgacuucgugggcaagauccaggggguccugacccagaccacgaagggcgacgggagcacccggggccacaaggccaccaucuacaccggcagcgcccccuucacgcccaagcugggguccgugcaguucaacaccgacaccgagaacgacuucgagacccaccagaacacgaaguucaccccggugggcgucauccaggacgggggcaccacccaccgcaacgagccccagcagugggugcuccccagcuacuccgggcggaacauccccaacgugcaccuggccccggccgucgcgcccacguuccccggcgagcagcuccucuucuuccgcagcaccaugcccggcugcuccggguacccgaacauggaccuggacugccugcucccccaggagugggugcagcacuucuaccaggaggccgcccccgcccagagcgacguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacgcucgcccccaugggcaacggcaccgggcgccggcgcgcccuguga

SEQ ID NO: 10579 - RNA, 1647 nt, Artificial Sequence
  derived and/or modified sequence opt1 from capsid_protein__Norovirus__AGC66785
augaagauggccagcaacgacgccacccccuccaacgacggcgcggccgggcuggugccggagaucaacagcgaggccauggcccucgagcccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucuccgccgcgcagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucacgguguccugccgggugcugacccgccccagccccgacuucuccuucaacuuccuggugcccccgaccguggagagcaagaccaagcccuucucccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcaugcugacccgcagcaccagccgggccuccgaccaggcggacacggccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacgccaccacccgggcgcacgaggccaagaucgacaccaccuccgggcgcuucacgcccaagcucggcagccuggagaucuccaccgagagcggcgacuucgaccagaaccagccgacccgguucacccccguggggaucggcgucgaccgcgaggccgacuuccagcaguggacgcugcccgacuacgccgggcaguucacccacaacaugaaccucgcgcccgccguggccccgaacuuccccggcgagcagcugcuguucuuccggucccagcuccccagcuccgggggccgcagcaacggcauccuggacugccuggucccccaggagugggugcagcacuucuaccaggaguccgccccgagccagacccagguggcccucguccgcuacaucaaccccgacaccgggcgggugcuguucgaggcgaagcugcacaagcucggcuucaugacgaucgccaaguccggggacagccccaucaccgugcccccgaacggcuacuuccgcuucgaguccugggucaaccccuucuacacccuggcccccauggggaccggcaacggccggcgccggauccaguga

SEQ ID NO: 10580 - RNA, 1644 nt, Artificial Sequence
  derived and/or modified sequence opt1 from capsid_protein__Norovirus__AGC66786
augaagauggccagcaacgacgccgcgcccuccaacgacggcgccgccaaccuggugcccgaggccgacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccggccugaacccguaccucucccaccugagccgcauguacaacggcuacgccgggggcaugcagguccagguggugcuggccgggaacgccuucaccgccggcaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggggaggacguguucaccgucuccugccgggugcugacgcgccccgcgcccgacuucgaguucaccuuccuggugccgcccaccgucgagagcaagaccaagcccuucacgcuccccauccugacccugggcgagcucuccaacagccgguucccggcccccaucgacaugcuguacaccgaccccaacgagaccaucguggugcagccccaguccggccgcugcacgcuggacgggacccuccagggcaccacccagcuggucccgacgcagaucugcagcuuccgggggacccugaucucccagaccagccgcuccgccgacagcaccgacuccgcgccccgggugcgcaaccacccgccccacguccagcucaagaaccuggacggcacgcccuacgaccccaccgacgaggugcccgccgugcugggcgcgaucgacuucaaggggaccgucuucggcguggccagccagcggaacaccaccgggggcagcgugggggccacccgcgcccacgagguccacaucgacaccaccaacccgcgguacacgcccaagcucggcuccgugcugauguacagcgaguccgacgacuucgacgacggccagcccacccgcuucacccccaucgggaugggcgccgacgacuggcaccagugggagcugccggaguacagcgggcaccucacccugaacaugaaccuggcgcccgccguggcccccgccuuccccggcgagcggauccucuucuuccgcuccgucgugccgagcgccgggggcuacggcuccgggcagaucgacugccugaucccccaggagugggugcagcacuucuaccaggaggcggcccccagccaguccgccgucgcccugauccgcuacgugaaccccgacacgggccggaacaucuucgaggcgaagcuccaccgcgagggguucaucaccguggccaacagcggcaacaacccgaucgucgugccgcccaacggguacuuccgguucgaggccugggugaaccaguucuacacccugacccccaugggcacgggccaggggcgccggcgcguccaguga

SEQ ID NO: 10581 - RNA, 1623 nt, Artificial Sequence
  derived and/or modified sequence opt1 from capsid_protein__Norovirus__AGC66788
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcgcuucuccacggacaccgagaacgacuucgagacccaccagaacaccaaguucacgcccgucggcgugauccaggacgggggcaccacccaccggaacgagccccagcagugggugcuccccaacuacagcggguccgacgucccgaacgugcaccuggcccccgccguggcgcccaacuuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 10582 - RNA, 1629 nt, Artificial Sequence
  derived and/or modified sequence opt1 from capsid_protein__Norovirus__AGL96587
augaagauggccagcaacgacgccgcgcccuccaacgacggcgccgccagccuggugccggaggggaucaacgagaccaugccccucgagcccgucgccggcgccuccaucgcggcccccguggccgggcagaccaacaucaucgacccguggauccgcacgaacuucgugcaggcccccaacggcgaguucaccgucagcccccggaacucccccggggagauccugcugaaccucgagcugggcccggaccugaaccccuaccucgcgcaccucccccgcauguacaacggcuacgccgggggcguggaggugcagguccugcuggccgggaacgccuucaccgccggcaagauccuguucgcggccaucccgcccaacuuccccguggacaugaucagccccgcccagaucaccaugcugccccaccucaucguggacguccggacgcuggagccgaucaugaucccccugcccgacgugcgcaacguguucuaccacuucaacaaccagccccagccgcggaugcgccucgucgccaugcuguacacgccccugcgguccaacgggagcggcgacgacgugcucaccguguccugccgcguccugacccggcccacccccgacuucgaguucaucuaccuggugccgcccagcguggaguccaagaccaagcccuucacccuccccauccugaccaucagcgagcugacgaacucccgcuucccgauccccaucgagcagcucuacaccgcccccaacgagaccaacgucgugcagugccagaacggccggugcacccuggacggggagcugcagggcacgacccagcuccugagcuccgcggugugcagcuaccgcgggcggaccgucgccaacaacggcgacaacugggaccagaaccugcuccagcugaccuacccgaacggcgccuccuacgaccccacggacgaggugcccgcgccccuggggacccaggacuucagcggcaugcucuacggggugcugacccaggacaacgucaacguguccaccggcgaggccaagaacgccaaggggaucuacaucagcacgaccagcggcaaguucaccccgaagaucggcuccaucgggcugcacagcaucaccgagcacguccaccccaaccagcagucccgcuucacgcccgugggcguggccgucaacgagaacacccccuuccagcagugggugcucccgcacuacgccgggagcacccggucccacaccaaccugggcacggcccuggcccccaccuuccccggggagcagcuccuguucuuccgcagccgggugcccugcguccagggccugcagggccaggacgcguucaucgacugccuccugccgcaggagugggugaaccacuucuaccaggaggccgcccccucccaggccgacguggcgcugauccgcuacgucaaccccgacaccgggcggacccucuucgaggccaagcugcaccgcagcggcuucaucacggugucccacaccggggccuacccccugguggucccgcccaacggccacuuccgguucgacagcugggugaaccaguucuacucccucgcccccauggggaccggcaacggccgccgccggauccaguga

SEQ ID NO: 10583 - RNA, 1623 nt, Artificial Sequence
  derived and/or modified sequence opt1 from capsid_protein__Norovirus__AGQ57036
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacuccggcgacgacgucuucaccgugagcugccgggugcucaccaagccgucccccgacuucgaguucaccuuccuggucccgcccaccguggagagcaagaccaagcaguucacgcugcccauccucaagaucuccgagaugaccaacagccgcuuccccgugcccgucgagaugauguacaccgcccggaacgagaaccagguggugcagccccagaacgggcgcgucacccuggacggcgagcugcucgggacgaccccgcugcuggcggugaacaucugcaaguucaagggcgaggugaucgccaagaacggcgacguccgguccuaccgcauggacauggagaucaccaacaccgacgggacgcccaucgaccccaccgaggacaccccgggccccaucgggagccccgacuuccagggcauccucuucgggguggccucccagcggaacaagaacgagcagaaccccgccacccgcgcccacgaggcggacaucaacacgggcggcgaccaguacgccccgaagcuggcccaggucaaguucuucagcgagucccaggacuucgaggugcaccagcccaccguguucacccccgucgggguggccggcgacgccagccaccccuuccggcagugggugcugccgcgcuacgggggccaccucaccaacaacacgcaccuggcgcccgccgucgcgccccuguuccccggggagcagauccucuucuuccggucccagaucccgagcagcggcggccacgagcugggguacauggacugccuggugccccaggagugggugcagcacuucuaccaggaggccgccaccgcccaguccgaggucgcccucauccgcuucaucaaccccgacaccggccgggugcuguucgaggccaagcugcacaagcagggguucaucaccguggcccacacgggcgacaaccccaucgucaugccgcccaacggguacuuccgcuucgaggcgugggugaaccaguucuacagccucgcccccgugggcaccggcaacgggcggcgccgcauccaguga

SEQ ID NO: 10584 - RNA, 1623 nt, Artificial Sequence
  derived and/or modified sequence opt1 from capsid_protein__Norovirus__AGT95926
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggugguguga

SEQ ID NO: 10585 - RNA, 1623 nt, Artificial Sequence
  derived and/or modified sequence opt1 from capsid_protein__Norovirus__AGT95927
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccacgccccuggagaagcuguucaccggcccguccagcgccuucgucgugcagccccagaacgggcgcugcaccaccgacggcgugcuccuggggaccacccagcucucccccgucaacaucugcacguuccggggcgacgugacccacaucaccggcagccgcaacuacaccaugaaccuggccucccagaacuggaacaacuacgacccgacggaggagauccccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggucaaccagaacaccaaguucacgcccgugggggugauccaggacggcgggaccacccaccgcaacgagccccagcaguggguccugcccuccuacagcggccggaacacccacaacgugcaccucgccccggccguggcgcccacguuccccggggagcagcugcuguucuuccgcuccaccaugcccggcugcagcggcuacccgaacauggaccucgacugccugcugccccaggaguggguccaguacuucuaccaggaggccgcccccgcccaguccgacguggcgcuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacgcuggcccccauggggaacggcaccggccgccgccggguggucuga

SEQ ID NO: 10586 - RNA, 1623 nt, Artificial Sequence
  derived and/or modified sequence opt1 from capsid_protein__Norovirus__AGT95928
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucagcaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggaugcucacccagaccacccgggccgacggcagcacgcgcgggcacaaggccaccgucuacaccggcuccgccgacuucgccccgaagcugggccgggugcaguucgagaccgacacggaccacgacuucgaggccaaccagaacaccaaguucacccccgugggggucauccaggacggcagcaccacgcaccgcaacgagccccagcagugggugcugcccuccuacagcgggcggaacacccacaacgugcaccucgcgccggccgucgcccccaccuuccccggcgagcagcugcuguucuuccgcuccaccaugcccgggugcagcggcuacccgaacauggaccucgacugccugcugccccaggagugggugcaguacuucuaccaggaggccgcgcccgcccaguccgacguggcccuccugcgguucgucaaccccgacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgggucguguga

SEQ ID NO: 10587 - RNA, 1623 nt, Artificial Sequence
  derived and/or modified sequence opt1 from capsid_protein__Norovirus__AGT95929
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgcaagcgcgugguguga

SEQ ID NO: 10588 - RNA, 1623 nt, Artificial Sequence
  derived and/or modified sequence opt1 from capsid_protein__Norovirus__AGT95930
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcacggacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacacccacaacguccaccucgccccggccguggcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgggccguguga

SEQ ID NO: 10589 - RNA, 1623 nt, Artificial Sequence
  derived and/or modified sequence opt1 from capsid_protein__Norovirus__AGT95931
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgagaccaaccagaacaccaaguucacgcccgucggggugauccaggacggcuccaccacccaccgcaacgagccccagcagugggugcugcccagcuacuccgggcggaacacccacaacguccaccucgccccggccguggcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgggccguguga

SEQ ID NO: 10590 - RNA, 1623 nt, Artificial Sequence
  derived and/or modified sequence opt1 from capsid_protein__Norovirus__AHC12655
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucagcaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccaucggggugauccaggacggcagcacgacccaccgcaacgagccccagcaguggguccugcccuccuacagcgggcggaacacccacaacgugcaccucgccccggcgguggcccccaccuuccccggcgagcagcugcuguucuuccgcuccacgaugcccgggugcagcggcuacccgaacauggaccucgacugccugcugccccaggaguggguccaguacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguggucuga

SEQ ID NO: 10591 - RNA, 1623 nt, Artificial Sequence
  derived and/or modified sequence opt1 from capsid_protein__Norovirus__AHC12658
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccaucccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcggcgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccgggccguccagcgccuucgugguccagccccagaacggccgcugcaccacggacggggugcuccugggcaccacccagcucucccccgugaacaucugcaccuuccggggcgacgucacgcacaucaccgggagccgcaacuacaccaugaaccuggccucccagaacuggaacaacuacgacccgaccgaggagauccccgcgccccugggcacgcccgacuucguggggaagauccagggcaugcucacccagaccacccggacggacgggagcacccgcggccacaaggccaccguguacaccggcagcgccgacuucgccccgaagcuggggcggguccaguucgagacggacaccgaccacgacuucgaggccaaccagaucaccaaguucacccccaucggcgugauccaggacggguccacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggugguguga

SEQ ID NO: 10592 - RNA, 1632 nt, Artificial Sequence
  derived and/or modified sequence opt1 from capsid_protein__Norovirus__AHW99832
augaugauggccagcaaggacgcccccuccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucaucugcugcgugccgcccggguuccagagccgcacccuguccaucgcgcaggccacgcuguucccccacaucaucgccgacguccggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucguggucgccggccgggugcugacgugccccuccagcgacuucaacuuccuguuccucgugccgcccaccgucgagcagaagacccgccccuucuccgugcccaacaucccccugcagcugcucagcaacucccgggugcccaaccugauccagagcaugguccuguccccggaccaggcgcagaacgugcaguuccagaacggccgcugcaccacggacgggcagcuccugggcaccacccccgugagcgucucccagauccugaaguuccgggggaaggugagcgccggcuccaaggugaucaaccucaccgagcuggacgggagccccuuccuggccuucgaggcccccgccccgacgggcuuccccgaccucggcaccagcgacuggcacgucgagaugucccugaacagcaacucccagagcuccgggaaccccauccugcuccgcgacauccacccgaacagcuccgaguucgugccccaccugggcagcgucugcgugaccgcggccaucgagguggccggggacuacaccggcacgauccaguggaccucccagcccagcaacgucacccccgugccggacgugaacuucuggaccaucccccacuacggguccaaccuggccgaggccagccagcucgcgcccgucguguacccgcccggcuucggcgaggccaucguguacuucaugucccccauccccgggcccaacacggcccacaagccgaaccugguccccugccugcucccccaggaguucgugacccacuucgugagcgagcaggcccccuccaugggcgaggcggcccugguccacuacguggacccggacaccaaccggaaccugggggaguucaagcucuaccccgagggcuucaucacgugcgugcccaacgggaccggcccccagcagcugccgcugaacggcgucuucguguucgccagcugggugucccgcuucuaccagcucaagcccgucgggaccgccagcuccgcccggggccgccugggggugcggcgcuga

SEQ ID NO: 10593 - RNA, 1647 nt, Artificial Sequence
  derived and/or modified sequence opt1 from capsid_protein__Norovirus__AHZ12735
augaagauggccagcaacgacgccacccccuccaacgacggcgcggccgggcuggugccggagaucaacaacgaggccauggcccucgagcccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccaggagaucaaccccuaccucgcccaccuggcccggauguacaacggguacgccggcggguucgagguccagguggugcuggccggcaacgcguucaccgccgggaagaucaucuucgccgccaucccgcccaacuuccccaucgacaaccucagcgccgcgcagaucaccaugugcccccacgugaucguggacguccgccagcuggagccggugaaccugcccaugcccgacgugcggaacaacuucuuccacuacaaccagggcuccgacagccgccuccggcuggucgccaugcuguacacgccccuccgcgccaacaacuccggcgacgacguguucaccgugagcugccggguccugacccgcccgucccccgaguucagcuucaacuuccuggugccgcccaccguggaguccaagaccaagcccuucacgcuccccauccugaccaucagcgagauguccaacagccgguuccccguccccaucgacucccugcacaccagcccgaccgagaacaucguggugcagugccagaacgggcgcgucacgcucgacggcgagcugauggggaccacccagcugcuccccucccagaucugcgccuuccggggcgugcugacccgcagcacgucccggaccagcgaccaggccgacaccgcgacgccccgccuguucaacuacuacuggcacauccagcucgacaaccugaacggcacccccuacgacccggccgaggacauccccgggccccugggcaccccggacuuccgggggaagguguucggcgucgccagccagcgcaaccccgacuccaccacccgggcccacgaggccaagguggacacgaccgcggggcgcuucacccccaagcucggcagccuggagaucuccaccgagagcggcgacuucgaccagaaccagcccacgcgguucaccccggucgggaucggcguggaccgcgaggccgacuuccagcaguggucccugcccgacuacagcgggcaguucacccacaacaugaaccucgcccccgccguggcgcccaacuucccgggcgagcagcugcuguucuuccggucccagcuccccagcuccgggggccgcagcaacggcauccuggacugccuggucccccaggagugggugcagcacuucuaccaggaguccgcccccgcccagacccagguggcccucguccgcuacgugaacccggacacggggcgggugcuguucgaggccaagcugcacaagcucggcuucaugaccaucgcgaagaacggggacagccccaucaccgucccgcccaacggcuacuuccgcuucgaguccugggugaaccccuucuacacccuggcccccauggggacgggcaacggccggcgccgggugcaguga

SEQ ID NO: 10594 - RNA, 1647 nt, Artificial Sequence
  derived and/or modified sequence opt1 from capsid_protein__Norovirus__AHZ12736
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgaguucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacaacaccacccgggcccacgaggcgaagguggacaccacggccgggcgcuucacccccaagcucggcucccuggagaucagcaccgaguccggcgacuucgaccagaaccagccgacccgguucacgcccgucgggaucggcguggaccacgaggccgacuuccagcaguggagccugcccgacuacuccgggcaguucacccacaacaugaaccucgcccccgcgguggccccgaacuuccccggcgagcagcugcuguucuuccgcagccagcuccccuccagcgggggccgguccaacggcauccuggacugccuggucccccaggagugggugcagcacuucuaccaggagagcgccccggcccagacccagguggcccucguccgcuacgugaaccccgacaccgggcgcgugcuguucgaggcgaagcugcacaagcucggcuucaugacgaucgccaagaacggggacucccccaucaccgugcccccgaacggcuacuuccgguucgagagcugggugaaccccuucuacacccuggcccccauggggaccggcaacggccgccggcgcgugcaguga

SEQ ID NO: 10595 - RNA, 1647 nt, Artificial Sequence
  derived and/or modified sequence opt1 from capsid_protein__Norovirus__AHZ12737
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcccuucucccuccccauccugaccaucagcgagauguccaacagccgguuccccgugccgaucgacucccugcacacgagccccaccgagaacaucgucgugcagugccagaacgggcgcgugacccucgacggcgagcugauggggaccacgcagcugcuccccucccagaucugcgccuuccggggcacccugacccgcagcaccagccgggcguccgaccaggccgacacggccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacgcgaccacccgggcccacgaggccaagaucgacaccaccuccgggcgcuucacgcccaagcucggcagccuggagaucuccaccgagagcgacgacuucgaccagaaccagccgacccgguucacccccgugggcgucgggguggaccacgagcccgacuuccagcaguggguccugcccgacuacgccggccaguucacgcacaacaugaaccucgcgccggccguggcccccaacuuccccggggagcagcugcuguucuuccgcucccagcuccccagcuccggcgggcggagcaacggcauccuggacugccuggugccgcaggaguggguccagcacuucuaccaggaguccgcccccagccagacccagguggcccucgugcgcuacgucaaccccgacaccggccgcgugcuguucgaggcgaagcugcacaagcucggguucaugaccaucgccaaguccggcgacagccccaucacggugccgcccaacggguacuuccgguucgaguccugggucaaccccuucuacacccuggcccccaugggcaccgggaacggccgccggcgcauccaguga

SEQ ID NO: 10596 - RNA, 1647 nt, Artificial Sequence
  derived and/or modified sequence opt1 from capsid_protein__Norovirus__AHZ12738
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgaguucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcccacgaggcgaagguggacaccacggccgggcgcuucacccccaagcucggcagccuggagaucuccaccgagagcggcgacuucgaccagaaccagccgacccgguucacgcccgucgggaucggcguggaccacgaggccgacuuccagcaguggucccugcccgacuacagcgggcaguucacccacaacaugaaccucgcccccgcgguggccccgaacuuccccggcgagcagcugcuguucuuccgcucccagcuccccagcuccgggggccggagcaacggcauccuggacugccuggucccccaggagugggugcagcacuucuaccaggaguccgccccggcccagacccagguggcccucguccgcuacgugaaccccgacaccgggcgcgugcuguucgaggcgaagcugcacaagcucggcuucaugacgaucgccaagaacggggacagccccaucaccgugcccccgaacggcuacuuccgguucgaguccugggugaaccccuucuacacccuggcccccauggggaccggcaacggccgccggcgcgugcaguga

SEQ ID NO: 10597 - RNA, 1647 nt, Artificial Sequence
  derived and/or modified sequence opt1 from capsid_protein__Norovirus__AHZ12739
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgaguucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccggaccagcgaccaggccgacaccgcgacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcccacgaggccaagguggacacgaccgcggggcgcuucacccccaagcucggcagccuggagaucuccaccgagagcggcgacuucgaccagaaccagccgacgcgguucacccccgucgggaucggcguggaccacgaggccgacuuccagcaguggucccugcccgacuacagcgggcaguucacccacaacaugaaccucgcccccgccguggcgccgaacuuccccggcgagcagcugcuguucuuccgcucccagcuccccagcuccgggggccggagcaacggcauccuggacugccuggucccccaggagugggugcagcacuucuaccaggaguccgccccggcccagacccagguggcccucguccgcuacgugaaccccgacacggggcgcgugcuguucgaggccaagcugcacaagcucggcuucaugaccaucgcgaagaacggggacagccccaucaccgugcccccgaacggcuacuuccgguucgaguccugggugaaccccuucuacacccuggcccccauggggacgggcaacggccgccggcgcgugcaguga

SEQ ID NO: 10598 - RNA, 1623 nt, Artificial Sequence
  derived and/or modified sequence opt1 from capsid_protein__Norovirus__AHZ12912
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccguguccaucugcacguuccggggcgacgugacccacauccccggcagccacaacuacaccaugaaccuggccagccagaacuggaacuccuacgacccgaccgaggagauccccgcgccccuggggacgcccgacuucgucggcaagauccagggggugcucacccagaccacccgcacgaacggcagcacccgggggcacaaggccaccguguacaccggcuccgccgacuucagcccgaagcugggccgcguccaguucgccacggacaccaacaacgacuucgagaccaaccagaacaccaaguucacgcccgugggggugauccaggacggcuccaccacgccccggaacgagccccagcaguggguccugccgagcuacuccgggcgcaacauccacaacgugcaccucgcccccgccguggcccccaccuuccccggcgagcagcugcuguucuuccggagcaccaugccggggugcuccggcuaccccaacauggaccucgacugccugcugccccaggaguggguccaguacuucuaccaggaggcggcccccgcccagagcgacguggcccuccugcgcuucgugaacccggacaccggccggguccuguucgagugcaagcuccacaaguccggguacgugaccguggcgcacaccggccagcacgaccuggucaucccgcccaacggguacuuccgcuucgacagcugggugaaccaguucuacacccuggcccccaugggcaacgggacgggccggcgccgcgcccucuga

SEQ ID NO: 10599 - RNA, 1623 nt, Artificial Sequence; identical to SEQ ID NO: 10598
  derived and/or modified sequence opt1 from capsid_protein__Norovirus__AHZ12913

SEQ ID NO: 10600 - RNA, 1623 nt, Artificial Sequence
  derived and/or modified sequence opt1 from capsid_protein__Norovirus__AHZ12998
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugauccacaucagcggcucccgcaacuacaccaugaaccuggccagccagaacuggaacagcuacgacccgaccgaggagauccccgcgccccuggggacccccgacuucgucggcaagauccagggggugcucacgcagaccacccggaccaacggcuccacgcgcgggcacaaggccaccguguacaccggcagcgccgacuucuccccgaagcugggccggguccaguucgccaccgacacggacaacgacuucgagaccaaccagaacaccaaguucacccccgugggggugauccaggacggcagcacgacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggaccggccgccgccgggcccucuga

SEQ ID NO: 10601 - RNA, 1623 nt, Artificial Sequence; identical to SEQ ID NO: 10600
  derived and/or modified sequence opt1 from capsid_protein__Norovirus__AHZ13001

SEQ ID NO: 10602 - RNA, 1623 nt, Artificial Sequence; identical to SEQ ID NO: 10600
  derived and/or modified sequence opt1 from capsid_protein__Norovirus__AHZ13004

SEQ ID NO: 10603 - RNA, 1623 nt, Artificial Sequence; identical to SEQ ID NO: 10600
  derived and/or modified sequence opt1 from capsid_protein__Norovirus__AHZ13010

SEQ ID NO: 10604 - RNA, 1623 nt, Artificial Sequence; identical to SEQ ID NO: 10600
  derived and/or modified sequence opt1 from capsid_protein__Norovirus__AHZ13015

SEQ ID NO: 10605 - RNA, 1623 nt, Artificial Sequence; identical to SEQ ID NO: 10600
  derived and/or modified sequence opt1 from capsid_protein__Norovirus__AHZ13020

SEQ ID NO: 10606 - RNA, 1623 nt, Artificial Sequence; identical to SEQ ID NO: 10600
  derived and/or modified sequence opt1 from capsid_protein__Norovirus__AHZ13023

SEQ ID NO: 10607 - RNA, 1545 nt, Artificial Sequence
  derived and/or modified sequence opt1 from capsid_protein__Norovirus__AIC32559
auggcccuggagcccguggucggcgccgcgaucgccgccccgguggccgggcagcagaacgugaucgaccccuggauccgcaacaacuucguccaggcccccggcggggaguucaccgugagcccccggaacgcgccgggcgagauccucugguccgcgccccuggggcccgaccugaaccccuaccucagccaccuggcccgcauguacaacggcuacgccggcggguucgaggugcaggucauccuggccggcaacgccuucaccgccgggaaggugaucuucgccgccgugccgcccaacuuccccacggagggccucucccccagccaggucaccauguucccgcacaucgugguggacguccggcagcuggagcccgugcugaucccccuccccgacgugcgcaacaacuucuaccacuacaaccaguccaacgacccgaccaucaagcugaucgcgaugcuguacacgccccuccgggccaacaacgccggggacgacgucuucaccgugagcugccgcgugcugacccggcccucccccgacuucgacuucaucuuccuggucccgcccaccguggagagccgcaccaagcccuucuccgugcccguccucacgguggaggagaugaccaacagccgguucccgaucccccuggagaagcuguucaccggccccuccagcgccuucgugguccagccccagaacggccgcugcaccacggacggggugcuccugggcaccacccagcuguccccggucaacaucugcaccuuccgcggggacgugacgcacaucaccggcagccggaacuacaccaugaaccucgccucccagaacuggaacaacuacgaccccaccgaggagauccccgcgccgcugggcgcccccgacuucguggggaagauccagggcaugcugacgcagaccacccgggccgacgggagcacccgcggccacaaggccacggucuacaccggguccgccgacuucgcgcccaagcucggccgggugcaguucgagaccgacaccgaccacgacuucgaggccaaccagaacacgaaguucacccccgugggcgucauccaggacgggagcaccacccaccgcaacgagccgcagcagugggugcugcccuccuacagcggccggaacacgcacaacgugcaccuggcccccgccgucgcccccaccuucccgggggagcagcuccuguucuuccgcagcaccaugcccggcugcuccggguaccccaacauggaccuggacugccuccugccccaggagugggugcaguacuucuaccaggaggcggccccggcccagagcgacguggcccugcuccgguucgucaaccccgacaccggccgcgugcuguucgagugcaagcugcacaaguccggcuacgugacggucgcgcacaccgggcagcacgaccucgugaucccgcccaacggcuacuuccgguucgacagcugggugaaccaguucuacacccuggcccccauggggaacggcgccgggcgccgccgggucguguga

SEQ ID NO: 10608 - RNA, 1617 nt, Artificial Sequence
  derived and/or modified sequence opt1 from capsid_protein__Norovirus__AID51474
auggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcggacccuggagcccguccugcuccccaugccggacgugcgcagcacccuguuccacuucaaccagaaggacgagcccaagaugcggcugguggccaugcucuacacgccccugcgcuccaacgggagcggcgacgacgucuucaccguguccugccggauccugacccgccccagcccggaguucgacuucaccuaccucgugccgcccaccgucgaguccaagacgaagcccuucacccugcccgugcugacccucggcgagcugagcaacucccgguucccccugagcaucgacgagauggugaccucccccaacgagagcaucgucgugcagccccagaacgggcgcgugacgcucgacggcgagcugcuggggaccacccagcuccaggccugcaacaucugcuccauccggggcaaggucaccggccaggugccgaacgagcagcacauguggaaccuggagaucacgaaccugaacgggacccaguucgaccccaccgacgacguccccgccccgcucggcgugcccgacuucgcgggggagguguucggcguccugagccagcgcaaccgcggggagagcaaccccgccaaccgggcccacgacgccgugguggccaccuacuccgacaaguacacgcccaagcugggccucguccagaucggcaccuggaacaccaacgacguggagaaccagccgaccaaguucacgcccaucgggcugaacgagguggcgaacggccaccgguucgagcaguggacccugccccgcuacagcggggcccucacccugaacaugaaccuggcccccgccgucgccccgcuguuccccggcgagcggcuccuguucuuccgcuccuacgugccccucaagggcggguucggcaaccccgcgaucgacugccuggugccgcaggaguggguccagcacuucuaccaggagagcgcccccucccugggggacguggcccucgugcgguacgucaaccccgacaccggccgcgugcuguucgaggccaagcugcacaagggcggguuccucacggugagcuccaccagcaccgggcccgucguggugccggcgaacggcuacuuccgguucgacuccugggucaaccaguucuacagccuggcccccaugggcaccgggaacggccgccgccgguuccaguga

SEQ ID NO: 10609 - RNA, 1617 nt, Artificial Sequence; identical to SEQ ID NO: 10608
  derived and/or modified sequence opt1 from capsid_protein__Norovirus__AID51477

SEQ ID NO: 10610 - RNA, 1617 nt, Artificial Sequence; identical to SEQ ID NO: 10608
  derived and/or modified sequence opt1 from capsid_protein__Norovirus__AID51480

SEQ ID NO: 10611 - RNA, 1617 nt, Artificial Sequence; identical to SEQ ID NO: 10608
  derived and/or modified sequence opt1 from capsid_protein__Norovirus__AID51483

SEQ ID NO: 10612 - RNA, 1617 nt, Artificial Sequence; identical to SEQ ID NO: 10608
  derived and/or modified sequence opt1 from capsid_protein__Norovirus__AID51486

SEQ ID NO: 10613 - RNA, 1617 nt, Artificial Sequence; identical to SEQ ID NO: 10608
  derived and/or modified sequence opt1 from capsid_protein__Norovirus__AID51489

SEQ ID NO: 10614 - RNA, 1617 nt, Artificial Sequence; identical to SEQ ID NO: 10608
  derived and/or modified sequence opt1 from capsid_protein__Norovirus__AID51492

SEQ ID NO: 10615 - RNA, 1617 nt, Artificial Sequence; identical to SEQ ID NO: 10608
  derived and/or modified sequence opt1 from capsid_protein__Norovirus__AID51495

SEQ ID NO: 10616 - RNA, 1623 nt, Artificial Sequence
  derived and/or modified sequence opt1 from capsid_protein__Norovirus__AIE40036
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgaucgaggagaugaccaacagccgguuccccaucccccuggagaagcuguucaccggccccuccagcgccuucgugguccagccgcagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgaccccaccgaggagaucccggcgccccuggggacgcccgacuucgugggcaagauccaggggaugcucacccagaccacccggacggacggcagcacccgcgggcacaaggccaccgucuacaccggcagcgccgacuucgcccccaagcugggccgggugcaguucgagacggacaccgaccacgacuucgaggccaaccagaacaccaaguucaccccgaucggggugauccaggacggcuccacgacccaccgcaacgagccccagcaguggguccugcccagcuacuccgggcggaacacccacaacgugcaccucgcccccgcgguggccccgaccuuccccggcgagcagcugcuguucuuccgcagcacgaugcccgggugcuccggcuaccccaacauggaccucgacugccugcugccgcaggaguggguccaguacuucuaccaggaggccgcccccgcgcagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggacgggccgccgccgggcccucuga

SEQ ID NO: 10617 - RNA, 1647 nt, Artificial Sequence
  derived and/or modified sequence opt1 from capsid_protein__Norovirus__AJW87644
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugauccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacaccaccacgcgggcgcacgaggccaagaucgacaccaccagcgggcgcuucacccccaagcucggcucccuggagaucagcacggaguccgacgacuucgaccagaacaagccgacccgguucacccccgucggcaucgggguggaccacgaggccgacuuccagcaguggacccugcccgacuacgccggccaguucacgcacaacaugaaccucgcgcccgccgucgccccgaacuuccccggggagcagcugcuguucuuccgcagccagcuccccuccagcggcgggcgguccaacggcauccuggacugccuggugccccaggagugggugcagcacuucuaccaggagagcgccccgucccagagccaggucgcccucgugcgcuacaucaaccccgacaccggccgcgugcuguucgaggcgaagcugcacaagcucggguucaucaccaucgccaagaacggcgacucccccaucaccgugcccccgaacggguacuuccgguucgagagcugggucaaccccuucuacacgcuggcccccaugggcaccgggaacggccgccggcgcauccaguga

SEQ ID NO: 10618 - RNA, 1623 nt, Artificial Sequence
  derived and/or modified sequence opt1 from capsid_protein__Norovirus__ALG05457
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugagcccggaccucaaccccuaccuggcgcaccugucccgcauguacaacggcuacgccgggggcguggaggugcagguccuccuggccgggaacgccuucaccgccggcaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacgggagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacggccggugcacccuggacggggagcugcagggcacgacccagcuccugccgagcgggaucugcgcguuccgcggccgggucaccgcccagaucaaccagcgcgaccgguggcacaugcagcugcagaaccucaacggcaccacguacgaccccaccgacgacgugcccgccccgcuggggacccccgacuucaagggcguggucuucgggauggugucccagcgcaacgucggcaacgacgcccccgggagcacccgggcccagcaggcgugggugagcacguacagcccccaguucgugccgaagcugggcuccgucaaccuccgcaucuccgacaacgacgacuuccaguuccagcccaccaaguucacccccgugggcgugaacgacgacgacgacgggcaccccuuccggcagugggagcugccgaacuacagcggcgagcugacccucaacaugaaccuggccccgcccgucgcccccaacuuccccggggagcagcuccuguucuuccgcuccuucgugcccugcagcggcggguacaaccagggcaucaucgacugccugaucccccaggaguggauccagcacuucuaccaggaguccgcccccagccaguccgacguggcccugauccgguacgucaacccggacacgggccgcacccucuucgaggcgaagcugcaccgcagcggguacaucaccguggcccacuccggcgacuacccccuggugguccccgccaacgggcacuuccgguucgacagcugggugaaccaguucuacucccucgcccccaugggcaccgggaacggccgccggcgcgcgcaguga

SEQ ID NO: 10619 - RNA, 1623 nt, Artificial Sequence
  derived and/or modified sequence opt1 from capsid_protein__Norovirus__ALG05460
augaagauggccagcaacgacgccgcgcccuccaacgacggcgccgccgggcuggugccggagggcaacgacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacugcagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccacccaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgacuccugggugaaccaguucuacagccucgcccccauggggaccggcaacggccgccggcgcgcgcaguga

SEQ ID NO: 10620 - RNA, 1623 nt, Artificial Sequence
  derived and/or modified sequence opt1 from capsid_protein__Norovirus__ALL73873
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucggguccgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggaccggcaacggccgccggcgcgcgcaguga

SEQ ID NO: 10621 - RNA, 1623 nt, Artificial Sequence; identical to SEQ ID NO: 9820
  derived and/or modified sequence opt1 from capsid_protein__Norovirus__ALL73876

SEQ ID NO: 10622 - RNA, 1623 nt, Artificial Sequence
  derived and/or modified sequence opt1 from capsid_protein__Norovirus__ALL73879
augaagauggccagcaacgacgccgcgcccuccaacgacggcgccgccgggcuggugccggagggcaacaacgagacccucccccuggagcccgucgccggggccgcgaucgccgccagcgugaccggccagaacaacaucaucgaccccuggauccgcacgaacuucgugcaggccccgaacggggaguucaccgucagcccccggaacucccccggcgagauccugcucaaccuggagcugggccccgaccucaacccguaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccccugccggacgugcgcaacaccuucuuccacuacuccaaccagcccaacagccggaugcgccuggucgccaugcucuacacgccccugcgguccaacggcagcggcgacgacguguucaccguguccugccgcguccugacccggcccaccccggacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugcccagcggcaucugcgcguuccgcggccgggucaccgcccagaucaaccagcgcgaccgguggcacaugcagcugcagaaccucaacgggaccacguacgacccgaccgacgacgugcccgcgccccugggcaccccggacuucaaggggguggucuucggcauggugucccagcgcaacgucgggaacgacgcccccggcagcacccgggcccagcaggccugggugagcacguacagcccccaguucgugcccaagcugggcuccgucaaccuccgcaucuccgacaacgacgacuuccaguuccagccgaccaaguucacccccgugggggugaacgacgacgacgacggccaccccuuccggcagugggagcugcccaacuacagcggggagcugacccucaacaugaaccuggccccgcccgucgcccccaacuuccccggcgagcagcuccuguucuuccgcuccuucgugccgugcagcgggggcuacaaccagggcaucaucgacugccugaucccccaggaguggauccagcacuucuaccaggaguccgcccccagccaguccgacguggcccugauccgguacgucaaccccgacacggggcgcacccucuucgaggcgaagcugcaccgcagcggcuacaucaccguggcccacuccggggacuacccgcuggugguccccgccaacggccacuuccgguucgacagcugggugaaccaguucuacucccucgcccccauggggaccggcaacggccgccggcgcgcgcaguga

SEQ ID NO: 10623 - RNA, 1623 nt, Artificial Sequence; identical to SEQ ID NO: 9820
  derived and/or modified sequence opt1 from capsid_protein__Norovirus__ALL73882

SEQ ID NO: 10624 - RNA, 1623 nt, Artificial Sequence; identical to SEQ ID NO: 9820
  derived and/or modified sequence opt1 from capsid_protein__Norovirus__ALL73888

SEQ ID NO: 10625 - RNA, 1623 nt, Artificial Sequence
  derived and/or modified sequence opt1 from capsid_protein__Norovirus__ALQ43927
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccgaccacgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcccccucuga

SEQ ID NO: 10626 - RNA, 1623 nt, Artificial Sequence
  derived and/or modified sequence opt1 from capsid_protein__Norovirus__ALQ43928
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccggccccucuga

SEQ ID NO: 10627 - RNA, 1623 nt, Artificial Sequence; identical to SEQ ID NO: 9179
  derived and/or modified sequence opt1 from capsid_protein__Norovirus__ALQ44123

SEQ ID NO: 10628 - RNA, 1623 nt, Artificial Sequence; identical to SEQ ID NO: 9820
  derived and/or modified sequence opt1 from capsid_protein__Norovirus__ALQ44124

SEQ ID NO: 10629 - RNA, 1623 nt, Artificial Sequence; identical to SEQ ID NO: 9820
  derived and/or modified sequence opt1 from capsid_protein__Norovirus__ALQ44125

SEQ ID NO: 10630 - RNA, 1644 nt, Artificial Sequence
  derived and/or modified sequence opt1 from capsid_protein__Norovirus__BAB83514
augaagauggccagcuccgacgccgcgcccagcaccgacggcuccgccgggcuggugccggaggucaacaacgagaccauggcccucgagcccguggugggcgcgccccuggccgcccccgucgccgggcagcacaacaucaucgacccguggaucaagaugaacuucgugcaggcccccaacggcgaguucacggugagcccccgcaacgcccccggggagauccugcucgaccuggagcugggcccggaccucaaccccuaccugucccaccuggcgcggauguacaacggcuacgccgggggcauggagguccagguggugcucgccgggaacgccuucaccgccggcaagaucaucuucgcggccgucccgcccaacuuccccgccgagaaccugagcgccgcccaggugaccaugugcccccacgugaucgucgacgugcgccagcuggagcccgugaugcuccccaugccggacauccggaacaagcuguuccacuacaaccaggucgacgaccccaagcugcgccuccuggcguaccuguacacgccccuccgggccaacaacgccggggacgacguguucaccguguccugccgcguccugacccggcccaccccggacuucgaguucauguuccuggugccgcccaccguggagagcaagacgaagcccuucucccuccccagccugacccuggacgagcucuccaacagccgcuuccccgcccccaucguccagcuguacaccaacccccacgacaaccugguggugcagccgcagaacggccggugcaccaucgacggccuccugcaggggacgacccagcuggucuccugcaacgugugcagcuuccgcggcaccaucggggacggccagcccgccucccacagcgaggaggagaucaugcccauggcguucaacauccagcgggagaucaugcucgagaaccuggacggcaccccguacgaccccgccgacgacauccccgccguccuggggucccccgacuuccagggcgugaucuucgggauccucagccagcgcaacacggacggccagacccgggcccacgaggccaagguggacacccgcgcggcccgguucgccccgaagcugggguucgucguggccaccguggaguccacggacuuccacgcgaaccagcccagccgcuucacccccgucggccugggcggggacaacaaccaggacuucaaccaguggcggcuccccgccuacggcggggcccugaccaacaacaccaaccuggccccgcccgugaugcccguguaccccggcgagcagcuccuguucuuccgcagccagcugccguccagcgggggcgucgugggcggguggcucgacugccugcugccccaggagugggugcagcacuucuuccaggaguccgccacgagccaguccgacgucgcgcucgugcgguacaucaaccccaccaccggccgcgugcuguucgaggccaagcugcacaagcagggguuccucaccgucgccgccagcggcuccuacccccugguggugccggccgacggguacuuccgguucgagagcugggucaaccaguucuacacgcuggcgcccaugggcaacggcuccgggcgccgccgggcccgcuga

SEQ ID NO: 10631 - RNA, 1644 nt, Artificial Sequence
  derived and/or modified sequence opt1 from capsid_protein__Norovirus__BAB83516
augaagauggccagcuccgacgcgcccccgagcaccgacggcuccgcggggcuggugcccgaggucaacaacgagaccauggcccucgagcccguggugggcgcgccccuggccgccccggucgccgggcagcacaacaucaucgaccccuggaucaagaugaacuucgugcaggcccccaacggcgaguucacggugagcccccgcaacgccccgggggagauccugcucgaccuggagcugggccccgaccucaaccccuaccugucccaccuggcccggauguacaacggcuacgccgggggcauggagguccagguggugcucgccgggaacgccuucaccgccggcaagaucaucuucgccgcggugcccccgaacuuccccgccgagaaccugagcgccgcccaggucaccaugugcccccacgugaucgucgacgugcgccagcuggagcccgugaugcucccgaugcccgacauccggaacaagcuguuccacuacaaccaggucgacgaccccaagcugcgccuccuggccuaccuguacacgccccuccgggcgaacaacgccggggacgacguguucaccguguccugccgcguccugacccggccgacccccgacuucgaguucauguuccuggugccgcccaccguggagagcaagacgaagcccuucucccuccccggccugacccuggacgagcucagcaacucccgcuuccccgcccccaucguccagcuguacaccaacccgcacgacaaccugaucgugcagccccagaacggccggugcaccaucgacgggcuccugcagggcacgacccagcuggugagcugcaacgucugcuccuuccgcgggaccaugggcgagggccagcccgccgcccacagcgaggacgagaucaugccgauggcguucaacgugcagcgggagaucaugcucgagaaccuggacgggucccccuacgaccccaccgacgacauccccgccguccugggcagcccggacuuccagggggugauguucggcauccucucccagcgcaacacggacgggcagacccgggcccacgaggccaagguggacacccgcgccgcgcgguucgcccccaagcugggcuucgucguggccaccguggagagcacggacuuccacgccaaccagcccucccgcuucacccccgucggccucgggggcgacaccaaccgggacuucaaccaguggcagcugccggcguacgggggcgcccugaccaacaacacgaaccuggccccgcccgugaugcccguguaccccggggagcagcuccuguucuuccgcagccagcugcccagcuccggcggcgucguggccggguggcucgacugccugcugccccaggagugggugcagcacuucuuccaggagagcgccaccucccagagcgacgucgcgcucgugcgguacgugaaccccaccaccggccgcguccuguucgaggccaagcugcacaagcagggguuccucacgguggccgccuccggcagcuacccgcuggugguccccgccgacggguacuuccgguucgaguccugggugaaccaguucuacacccuggcgcccaugggcaacggcagcgggcgccgccgggcccgcuga

SEQ ID NO: 10632 - RNA, 1629 nt, Artificial Sequence
  derived and/or modified sequence opt1 from capsid_protein__Norovirus__BAD72797
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggcccccguucgaccccuccgaggacauccccgccccgcucggcgugcccgacuuccaggggcggguguucggcgucaucagccagcgcgacaagcagaacgcggccgggcacuccgagcccgccaaccggggccacgacgccguggugcccacguacaccgcccaguacaccccgaagcugggccagguccagaucgggaccuggcagacggacgaccuccaggugaaccagcccgugaaguucacccccgucggccugaacgacaccgagcacuucaaccaguggguggugccccgcuacgcgggggcccugaaccugaacaccaaccucgccccgagcgucgcccccguguuccccggcgagcggcugcuguucuuccgcagcuacaucccccucaagggcggguacggcaacccggcgaucgacugccugcugccccaggagugggugcagcacuucuaccaggaggccgcccccuccaugagcgaggucgcccucgugcgguacaucaaccccgacacggggcgcgcccuguucgaggcgaagcugcaccgggccggcuucgugaccgucuccagcaacaccuccgccccgguggugguccccgccaacggguacuuccgcuucgacagcugggugaaccaguucuacucccucgcccccaugggcgcggggaacggccggcgccgcgugcaguga

SEQ ID NO: 10633 - RNA, 1647 nt, Artificial Sequence
  derived and/or modified sequence opt1 from capsid_protein__Norovirus__BAD72798
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuucuacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgagucccugcacaccagccccaccgagaacaucgucgugcagugccagaacgggcgcgugacccucgacggcgagcugauggggacgacccagcugcuccccucccagaucugcgccuuccggggcguccugacccgcagcaccucccgggcgagcgaccaggccgacacggccacgccccgccuguucaacuacuacuggcacgugcagcucgacaaccugaacggcaccccguacgaccccgccgaggacauccccgggccgcugggcacccccgacuuccgggggaagguguucggcgucgccagccagcgcaaccccgacuccaccacccgggcgcacgaggccaagguggacaccaccgccgggcgcuucacgcccaagcucggcagccuggagaucuccaccgagagcuccgacuucgaccagaaccagccgacccgguucacccccgucggcaucgggguggacaacgaggccgacuuccagcaguggagccugcccgacuacuccggccaguucacgcacaacaugaaccucgcgcccgccguggccccgaacuuccccggggagcagcugcuguucuuccgcagccagcuccccuccagcggcgggcgguccaacggcguccuggacugccuggugccccaggagugggugcagcacuucuaccaggagagcgccccggcccagacccaggucgcgcucgugcgcuacgugaaccccgacaccggccgcguccuguucggggccaagcugcacaagcucggcuucaugaccaucgccaagaacggggacucccccaucacggugcccccgaacggcuacuuccgguucgagagcugggugaaccccuucuacacccuggcccccauggggaccggcaacggccgccggcgcauccaguga

SEQ ID NO: 10634 - RNA, 1647 nt, Artificial Sequence
  derived and/or modified sequence opt1 from capsid_protein__Norovirus__BAD72799
augaagauggccagcaacgacgccgcgcccuccaacgacggcgccgccgggcuggugccggagagcaacaacgaggucauggcccucgagcccguggccggcgcgucccuggccgcccccgugaccgggcagaccaacaucaucgaccccuggauccgcaugaacuucguccaggccccgaacggcgaguucacggugagcccccggaacucccccggggaggugcugcucaaccuggagcugggccccgagcucaacccguaccuggcgcaccugagccgcauguacaacggcuacgccgggggcauggagguccagaucaugcucgccgggaacgccuucaccgccggcaagcugaucuucgcggccgugccgccccacuuccccaucgagaaccuguccccgccccagaucaccauguucccccacgugaucaucgacguccggacccucgagcccgugcugcugcccaugcccgacauccgcaacagcuucuuccacuucauccagcgggacgagcccaagaugcgccucguggccaugcuguacacgccccugcgguccaacgggagcggcgacgacgucuucaccguguccugccgcgugcucacccggccgacccccgacuucgacuucacguaccuggucccgcccaccguggagagcaaguccaagcccuucacccugcccauccucacccugggcgagcugacgaacagccgcuucccccuccccaucgacgugcuguacaccaacccgaacgaguccgccaucguccagugccagaacgggcggugcacccugggcggggagcuccagggcaccgcccagcugcugcccacgggcaucugcgcguuccgcgggaaggugacccagcagguccaggacgagcaccggggcacccacuggaacaugaccgugacgaagcucaacgggacccccuucgacccgaccgaggacgugcccgcgccccugggcacccccgacuucagcgggcagaucuacggcgugaucucccagcgcaacacgaacaccgucccgggcgaggggaaccugcccgccaaccgggcccacgaggccgugaucgccaccuacagccccaaguucacccccaagcucggcaacauccaguucuccacgugggagacccaggacgucagcagcgggcagccgaccaaguucacccccgugggccuggccuccguggacgccaacagccacuucgaccaguggacgcugcccuccuacagcggggcccucacccugaacaugaaccuggcccccuccgucgcgccgguguuccccggcgagugccuccuguucuuccgcagcuucaucccccugaagggcggguacggcaaccccgccaucgacugccucaugccgcaggagugggugcagcaccuguaccaggaguccgcccccagccuguccgacgucgcccucgugcgguacgugaaccccgagaccgggcgcacccuguucgaggcgaagcugcaccggaacggcuuccucacggucgcccgcaacagcgccgggcccgugguggccccgaccaacggcuacuuccgguucgacuccugggucaaccaguucuacacccuggcccccaugggcaacgggagcggccgccgccggauccaguga

SEQ ID NO: 10635 - RNA, 1623 nt, Artificial Sequence
  derived and/or modified sequence opt1 from capsid_protein__Norovirus__BAD72800
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucgcccgcauguacaacggcuacgccgggggcguggagguccaggugcugcuggccgggaacgccuucaccgcgggcaagcucguguucgccgccaucccgccccacuuccccgucgacaaccugucccccgggcagaucaccauguucccccacgugaucaucgacgugcggacccuggagcccguccuccugccccugccggacgugcgcaacaacuucuuccacuacaaccagcagagcgaccagcggaugcgccucaucgccaugcuguacacgccccugcgguccaacggcagcggcgacgacguguucaccgucuccugccgcgugcucacccggcccagccccgacuuccacuuccacuaccuggugccgcccaccgucgaguccaagacgaagcccuucagcgugcccgugcugacccucaacgagcugaccaacucccgcuucccgguccccaucgacgccauguacaccagccccaacgacuccaucguggugcagccccagaacgggcgggcgacgaucgacggcgagcugcucgggaccacccagcugaucccgagcggcaucugcuccuuccgcggcaagaucaccacgcaccuggccgacgaccggcaccucuggaacauccaggucagcaaccugaacgggacccccuucgaccccaccgacgacgugccggcgccccugggcaugcccgacuucuccgggcagaucuucggcgucgugagcgagcgcgacaccgggacgaaccccgccaaccgggcccacgacgccgugcucgccaccuacagcgccaaguacaccccgaagcugggcuccguccagaucggcaccugggacacggaggaccugcucgagcgccagcccgugaaguucacccccguggggcugaacgagaucggccaggacaagcacuucgaccaguggguccugcccaacuacagcggggcccucggccugaacaugcaccuggccccggcggugagcccccucuuccccggggagcggcugcuguucuuccgcuccuacaucccccucaagggcggccacggggacccguucaucgacugccuggugccccaggaguggauccagcacuucuaccaggaguccgcccccgcccagagcuccgucgcccugcuccgguacgugaaccccgacaccggccgcacccuguucgaggcgaagcugcacaaggagggguucaucacggugagcuccaccgagaaccggccggucaucgugccgcccaacggcuacuuccgcuucgacagcugggugaaccaguucuacucccuggcccccauggggaccggcaacggccgccggcgcauccaguga

SEQ ID NO: 10636 - RNA, 1620 nt, Artificial Sequence
  derived and/or modified sequence opt1 from capsid_protein__Norovirus__BAD88558
augaagauggccagcaacgacgugaaccccuccgacggcagcgccgcgaaccuggucccggaggugaacaacgaggugauggcccucgagcccgucgugggggccgccaucgccgcgcccguggccggccagcagaacaucaucgaccccuggauccgcaacaacuucguccaggcccccgggggcgaguucaccgugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgcggccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggccaacaacgcgggcgacgacguguucaccgucagcugccgcgugcucacccggcccuccccggacuucgacuucaucuuccuggugccgcccaccgucgagagccgcaccaaguccuucacggugcccgugcugaccgucgaggagaugaccaacagccgguuccccaucccccucgagaagcuguacaccggccccuccagcgccuucgugguccagccccagaacgggcgcugcacgaccgacggcgugcugcucgggaccacccagcuguccgccgugaacaucugcacguuccggggcgacgucacccacaucgccggcagccgcaacuacaccaugaaccuggccucccagaacuggaacaacuacgacccgaccgaggagauccccgcgccccucgggaucccggacuucgugggcaagauccaggggcugcugacgcagaccacccgggccgacggcagcacccgcgcccacaaggccacggugagcaccggguccguccacuucacccccaagcucggcagcgugcaguucuccaccgacacggacaacgacuuccagcccggccagaacaccaaguucacccccgugggggucauccaggacggcgaccggcaccagaacgagccgcagcagugggugcugcccgacuacagcgggcgcaccggccacaacgugcaccuggcccccgcggucgcccccacguucccgggggagcagcuccuguucuuccgguccaccaugcccggcugcagcggcuaccccaacaugaaccuggacugccuccugccccaggagugggugcugcacuucuaccaggaguccgccccggcccagagcgacguggcgcuccugcgcuucgucaaccccgacaccaaccgggugcuguucgagugcaagcuccacaaguccggguacaucaccguggcccacacgggccagcacgaccugauccugccgcccaacggguacuuccgcuucgacagcugggucaaccaguucuacacccucgcccccaugggcaacggggccggccggcgccgcgcccccuga

SEQ ID NO: 10637 - RNA, 1623 nt, Artificial Sequence
  derived and/or modified sequence opt1 from capsid_protein__Norovirus__BAD98240
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcggacccuggagcccguccugcuccccaugccggacgugcgcagcacccuguuccacuucaaccagaaggacgagcccaagaugcggcugguggccaugcucuacacgccccugcgcuccaacgggagcggcgacgacgucuucaccguguccugccggauccugacccgccccagcccggaguucgacuucaccuaccucgugccgcccaccgucgaguccaagacgaagcccuucacccugcccgugcugacccucggcgagcugagcaacucccgguucccccugagcaucgacgagauggugaccucccccaacgagagcaucgucgugcagccccagaacgggcgcgugacgcucgacggcgagcugcuggggaccacccagcuccaggccugcaacaucugcuccauccggggcaaggucaccggccaggugccgaacgagcagcacauguggaaccuggagaucacgaaccugaacgggacccaguucgaccccaccgacgacguccccgccccgcucggcgugcccgacuucgcgggggagguguucggcguccugagccagcgcaaccgcggggagagcaaccccgccaaccgggcccacgacgccgugguggccaccuacuccgacaaguacacgcccaagcugggccucguccagaucggcaccuggaacaccaacgacguggagaaccagccgaccaaguucacgcccaucgggcugaacgagguggcgaacggccaccgguucgagcaguggacccugccccgcuacagcggggcccucacccugaacaugaaccuggcccccgccgucgccccgcuguuccccggcgagcggcuccuguucuuccgcuccuacgugccccucaagggcggguucggcaaccccgcgaucgacugccuggugccgcaggaguggguccagcacuucuaccaggagagcgcccccucccugggggacguggcccucgugcgguacgucaaccccgacaccggccgcgugcuguucgaggccaagcugcacaagggcggguuccucacggugagcuccaccagcaccgggcccgucguggugccggcgaacggcuacuuccgguucgacuccugggucaaccaguucuacagccuggcccccaugggcaccgggaacggccgccgccgguuccaguga

SEQ ID NO: 10638 - RNA, 1632 nt, Artificial Sequence
  derived and/or modified sequence opt1 from capsid_protein__Norovirus__BAE43833
augaugauggccagcaaggacgcccccaccaacauggacggcaccuccggggcgggccagcuggugccggaggccagcacggccgagcccaucuccauggagcccgucgccggggccgcgaccgccgccgccaccgcgggccaggugaacaugaucgaccccuggaucaugagcaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugcgcgugcuccuggccgggaacgccuucaccgcgggcaagaucaucaucuccugcgucccgcccggguucgccgcccagaacgugagcaucgcccaggccaccauguucccccacgugaucgcggacguccgggugcuggagcccaucgaggugccccucgaggacguccgcaacgugcuguuccacaacaacgacuccacccccacgaugcggcugaucugcaugcucuacacgccccugcgcgccagcggcuccagcuccggcaccgacccguucgugaucgccgggcggguccugaccugccccagccccgacuucaacuuccucuuccuggugcccccgaacguggagcagaagaccaagcccuucuccguccccaaccugccccucaacgugcugagcaacucccgcgugccgagccugaucaaguccaugauggucagccaggaccacggccagauggugcacuuccagaucgggcgggugacccucgacggccagcugcagggcaccacccccacgagcgccucccagcugugcaagauccgcgggaccgucuaccacgccaccggcgggcagggccucaaccugaccgagaucgacgggacgcccuaccacgcguucgagagccccgccccgaucggcuuccccgaccugggcgagugcgacuggcacaucaacgccucccccgccaacgccuucaccgacgggagcaucauccaccggaucgacguggcgcaggacuccaccuucgccccgcaccucggcaccauccacuacacgaacgccaacuacgacgccaacgucagccugaucugcucccuggaguggcucagcccgcccuccgggggcgcgcccaaggugaaccccugggccaucccccgcuacgggagcacccugaccgaggccgcccagcuggccccgcccaucuacccgcccggcuucggcgaggcgaucguguucuucauguccgacuuccccaucgccaacgggagcgacggccucuccguccccugcaccaucccccaggaguucgugacgcacuucgugaacgagcaggcccccacccgcggggaggccgcccugcugcacuacgucgaccccgacacccaccggaaccucggcgaguucaagcuguaccccgagggguucaugaccugcgugccgaacagcuccggcagcggcccccagacgcugcccaucaacgggguguucaccuucaucuccugggucagccgguucuaccagcucaagcccgugggcaccaccgggccggugcgccggcugggcauccgccgguccuga

SEQ ID NO: 10639 - RNA, 1647 nt, Artificial Sequence
  derived and/or modified sequence opt1 from capsid_protein__Norovirus__BAE48588
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgcccgcaagaucaucuucgccgccaucccgcccaacuuccccaucgacaaccucagcgccgcgcacaucaccaugugcccccacgugaucguggacguccggcagcuggagcccgugaaccugcccaugcccgacgugcgcaacaacuucuuccacuacaaccagggguccgacagccggcuccgccugaucgccaugcuguacaccccgcuccgggccaacaacuccggcgacgacgucuucacggugagcugccgcgugcugacccggcccucccccgacuucagcuucaacuuccuggugcccccgacccucgaguccaagaccaagcccuucacgcugcccauccugaccaucagcgagauguccaacagccgcuuccccgugccgaucgacucccuccacaccagccccaccgagaacaucgugguccagugccagaacggccgggugacgcuggacggggagcugaugggcaccacccagcuccugcccucccagaucugcgccuuccgcggggugcugacccggagcacgucccgcgcccgggaccaggcggacaccgccacgccccgccucuucaacuacuacuggcacauccagcuggacaaccugaacggcaccccguacgaccccgccgaggacauccccggcccgcucgggacccccgacuuccggggcaaggucuucgggguggccagccagcgcaaccccgacagcaccacccgggcccacgaggcgaagguggacaccacggccggccgcuucacccccaagcuggggucccuggagaucagcaccgaguccgacgacuucgaccagaaccagccgacccgguucacgcccgucggcaucggcguggacaacgaggccgacuuccagcaguggagccuccccgacuacuccgggcaguucacccacaacaugaaccuggcccccgcggucgccccgaacuuccccggcgagcagcuccuguucuuccgcagccagcugcccuccagcgggggccgcuccaacgggauccuggacugccucgugccccaggagugggugcagcacuucuaccaggagagcgccccgucccagacccaggucgcccuggugcgguacgugaaccccgacaccggccgcguccuguucgaggccaagcuccacaagcugggcuucacgaccaucgcgaagaacggggacagccccaucaccgugcccccgaacggcuacuuccgguucgaguccugggugaaccccuucuacacccuggcccccauggggacgggcaacgggcgccggcgcaaccaguga

SEQ ID NO: 10640 - RNA, 1647 nt, Artificial Sequence
  derived and/or modified sequence opt1 from capsid_protein__Norovirus__BAE48589
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccuacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagccugcggguccugacccgccccucccccgacuucagcuucaacuuccucgugcccccgaccguggaguccaagaccaagcccuucacgcugcccauccugaccaucagcgagauguccaacagccgguuccccgucccgaucgacucccuccacaccagccccaccgagaacaucguggugcagugccagaacgggcgcgucacgcuggacggcgagcugauggggaccacccagcuccugcccucccagaucugcgccuuccggggcgugcugacccgcagcacgucccgggccagcgaccaggcggacaccgccacgccccgccucuucaacuacuacuggcacauccagcuggacaaccugaacggcaccccguacgaccccgccgaggacauccccgggccgcucggcacccccgacuuccgggggaagguguucggcgucgccagccagcgcaaccccgacuccaccacccgggcccacgaggcgaagguggacaccacggccgggcgcuucacccccaagcugggcagccuggagaucuccaccgagagcgacgacuucgaccagaaccagccgacccgguucacgcccgucggcaucgggguggaccacgaggccgacuuccagcaguggucccuccccgacuacagcggccaguucacccacaacaugaaccuggcccccgcgguggccccgaacuuccccggggagcagcuccuguucuuccgcucccagcugcccagcuccggcgggcggagcaacggcauccuggacugccucgucccccaggagugggugcagcacuucuaccaggaguccgccccggcccagacccagguggcccugguccgcuacgugaaccccgacaccggccgcgugcuguucgaggcgaagcuccacaagcugggguucaugacgaucgccaagaacggcgacagccccaucaccgugcccccgaacggguacuuccgguucgaguccugggugaaccccuucuacacccuggcccccaugggcaccgggaacggccgccggcgcauccaguga

SEQ ID NO: 10641 - RNA, 1647 nt, Artificial Sequence
  derived and/or modified sequence opt1 from capsid_protein__Norovirus__BAE48590
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucgaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaccuucuuccacuacaaccagggcuccgacagccgccuccggcugaucgccaugcuguacacgccgcuccgcgccaacaacuccggcgacgacgucuucaccgugagcugccgggugcugacccgccccucccccgacuucagcuucaacuuccuggugcccccgaccguggaguccaagacgaagcccuucacccuccccauccugaccaucagcgagauguccaacagccgguuccccgugccgaucgacucccugcacaccagccccacggaguccaucgucgugcagugccagaacgggcgcgugacccucgacggcgagcugauggggaccacccagcugcuccccagccagaucugcgccuuccggggcguccugacgcgcuccaccagccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacagcaccacccgggcccacgaggcgaaggucgacacgaccaccgggcgcuucacccccaagcucggcucccuggagaucagcacggaguccgacgacuucgaccagaaccagccgacccgguucacccccgugggcaucggggucgaccacgaggccgacuuccagcaguggagccugcccgacuacuccggccaguucacccacaacaugaaccucgcccccgccguggcgccgaacuuccgcggggagcagcugcuguucuuccggagccagcuccccuccagcggcgggcgcuccaacggcacgcuggacugccuggugccccaggaguggguccagcacuucuaccaggagagcgcccccgcccagacccagguggcccucgugcgcuacgucaacccggacaccggccgggugcuguucgaggccaagcugcacaagcucggguucaugaccaucgcgaagaacggcgacucccccaucacggugccgcccaacggguacuuccgcuucgagagcugggucaaccccuucuacacccuggcccccaugggcaccgggaacggccggcgccggauccaguga

SEQ ID NO: 10642 - RNA, 1644 nt, Artificial Sequence
  derived and/or modified sequence opt1 from capsid_protein__Norovirus__BAE92970
augaagauggccagcaacgacgccucccccagcaccgacggcuccgcggggcuggugccggaggucaacaacgagaccauggcccucgagcccguggugggcgcgccccuggccgcccccgucgcggggcagcacaacaucaucgacccguggaucaagaugaacuucgugcaggcccccaacggcgaguucacggugagcccccgcaacgcccccggggagauccugcucgaccuggagcugggcccggaccucaaccccuaccugucccaccuggcccggauguacaacggcuacgccgggggcauggagguccagguggugcucgccgggaacgccuucaccgccggcaagaucaucuucgccgcggucccgcccaacuuccccgccgagaaccugagcgccgcccaggugaccaugugcccccacgugaucgucgacgugcgccagcuggagcccgugaugcuccccaugccggacauccggaacaagcuguuccacuacaaccaggucgacgaccccaagcugcgccuccuggccuaccuguacacgccccuccgggcgaacaacgccggggacgacguguucaccguguccugccgcguccugacccggcccaccccggacuucgaguucauguuccuggugccgcccaccguggagagcaagacgaagcccuucucccuccccagccugacccuggacgagcucuccaacagccgcuuccccgcccccaucguccagcuguacaccaacccccacgacaaccugguggugcagccgcagaacggccggugcaccaucgacggccuccugcaggggacgacccagcuggucuccugcaacgugugcagcuuccgcggcacccucggggacggccagcccgccucccacagcgaggaggagaucaugcccauggccuucaacguccagcgggagaucaugcuggagaaccuggacggcuccccguacgaccccaccgacgacauccccgcggugcucgggagccccgacuuccagggcguggucuucgggauccugucccagcgcaacacggacggccagacccgggcccacgaggccaagguggacacccgcgccgcccgguucgcgccgaagcugggguucguggucgccaccguggagagcacggacuuccacgccaaccagcccagccgcuucacccccgugggccucggcggggacggcaaccaggacuucaaccaguggucccugcccgccuacgggggcgcgcugaccaacaacaccaaccucgccccgcccgccaugcccgucuaccccggggagcagcugcuguucuuccggagccagcucccguccagcggcggcguggucgggggcuggcuggacugccugcucccccaggagugggugcagcacuucuuccaggaguccgccacgagccaguccgacguggcccuggugcgcuacaucaaccccaccaccgggcggguccuguucgaggcgaagcuccacaagcagggcuuccugaccguggccgccagcggguccuacccccugguggucccggccgacggcuacuuccgcuucgagagcugggugaaccaguucuacacgcuggcccccaugggcaacggguccggccggcgcagcgcgcgcuga

SEQ ID NO: 10643 - RNA, 1623 nt, Artificial Sequence
  derived and/or modified sequence opt1 from capsid_protein__Norovirus__BAE98191
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaccaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcaccaagcccuucaccguccccauccugaccguggaggagaugacgaacagccgguuccccaucccccuggagaagcuguucaccggccccuccagcgccuucgugguccagccgcagaacgggcgcugcaccaccgacggcgugcuccuggggacgacccagcucucccccgucaacaucugcaccuuccggggcgacgugauccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccgcccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacuccugggugaaccaguucuacacgcuggcccccaugggcaacggcgccgggcgccgccgggcccucuga

SEQ ID NO: 10644 - RNA, 1623 nt, Artificial Sequence
  derived and/or modified sequence opt1 from capsid_protein__Norovirus__BAE98194
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccgcccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacuccugggugaaccaguucuacacgcuggcccccaugggcaacggcgccgggcgccgccgggcccucuga

SEQ ID NO: 10645 - RNA, 1623 nt, Artificial Sequence
  derived and/or modified sequence opt1 from capsid_protein__Norovirus__BAE98197
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcacccgcacguaccggaugaaccuggccucccagaacuggaacaacuacgaccccaccgaggagaucccggcgccccuggggacccccgacuucgugggcaagauccaggggaugcucacccagacgaccaagggcgacgggagcacccgcggccacaaggccaccgucagcacgggcuccguggacuucacccccaagcuggggagcgugcaguucgccaccgacaccgacaacgacuucgagacgggccagaacacccgguucaccccggucggggugauccaggacggcuccagcacccaccgcaacgagccccagcagugggugcugcccgacuacuccgggcggacgguccacaacgugcaccucgcccccgccguggccccgaccuuccccggcgagcagcugcuguucuuccgcagcaccaugcccggcugcuccggguaccccaacauggaccucgacugccugcugccgcaggaguggguccagcacuucuaccaggaggccgcgcccagccaguccgacguggcccuccugcgguucgugaaccccgacaccggccgcguccuguucgagugcaagcuccacaaggccggguacgugaccguggcccacacgggccagcacgaccuggucaucccgcccaacggguacuuccgguucgacagcugggugaaccaguucuacacccuggcgcccaugggcaacggcgccgggcgccgccgggcccucuga

SEQ ID NO: 10646 - RNA, 1623 nt, Artificial Sequence
  derived and/or modified sequence opt1 from capsid_protein__Norovirus__BAF45861
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggccacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 10647 - RNA, 1620 nt, Artificial Sequence
  derived and/or modified sequence opt1 from capsid_protein__Norovirus__BAF74508
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcaccaagcccuucaccguccccauccugaccguggaggagaugagcaacucccgguuccccaucccccuggagaagcucuacacgggccccagcuccgccuucgugguccagccgcagaacgggcgcugcaccaccgacggcgugcugcuggggaccacgcagcucagcgccgucaacaucugcaccuuccggggcgacgugacccacaucgccggcucccacgacuacaccaugaaccuggccagccagaacuggaacaacuacgaccccacggaggagauccccgcgccgcuggggacccccgacuucgugggcaagauccaggggguccucacccagaccacgcgcggcgacgggagcacccgggcccacaaggccaccguguccaccggcagcgugcacuucacgcccaagcugggcuccguccaguacaccaccgacaccaacaacgacuuccagacggggcagaacaccaaguucacccccgugggcgugauccaggacggggacaaccaccagaacgagccgcagcaguggguccugcccaacuacagcggccgcaccgggcacaacgugcaccucgcccccgccguggcgcccacguucccgggcgagcagcugcuguucuuccgguccaccaugcccggcugcagcggguaccccaacaugaaccucgacugccugcugccccaggaguggguccagcacuucuaccaggaggccgccccggcccaguccgacguggcgcuccugcgcuucgugaaccccgacaccggccggguccuguucgagugcaagcuccacaagagcggguacgugaccguggcccacaccggcccccacgaccuggucaucccgcccaacggguacuuccgcuucgacuccugggugaaccaguucuacacgcuggcccccaugggcaacggcgccgggcggcgccgggcccucuga

SEQ ID NO: 10648 - RNA, 1620 nt, Artificial Sequence
  derived and/or modified sequence opt1 from capsid_protein__Norovirus__BAF74509
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgggcccucuga

SEQ ID NO: 10649 - RNA, 1620 nt, Artificial Sequence
  derived and/or modified sequence opt1 from capsid_protein__Norovirus__BAF74510
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccguguucugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcuccacgcgggcccacaaggccaccgucagcaccgggagcgugcacuucacccccaagcugggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgggcccucuga

SEQ ID NO: 10650 - RNA, 1620 nt, Artificial Sequence
  derived and/or modified sequence opt1 from capsid_protein__Norovirus__BAF74511
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcuguucaccggccccuccagcgccuucgugguccagccgcagaacgggcgcugcacgaccgacggcgugcuccuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacauggaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcuggaucaaccaguucuacacccuggcccccauggggaacggcgccggccggcgccgggcccucuga

SEQ ID NO: 10651 - RNA, 1620 nt, Artificial Sequence
  derived and/or modified sequence opt1 from capsid_protein__Norovirus__BAF74512
augaagauggccagcaacgacgccacccccuccgacggcagcaccgcgaaccuggugccggaggucaacaacgaggugauggcccucgagcccguggucggggccgccaucgccgcgcgcguggccggccagcagaacgugaucgaccccuggauccggaacaacuucguccaggcccccgggggcgaguucacgguguccccgcgcaacgcccccggggagauccuguggagcgcgccccugggccccgaccucaacccguaccugucccaccuggcccggauguacaacggcuacgccgggggcuucgaggugcaggucauccucgccgggaacgccuucaccgcgggcaagaucaucuucgccgccgugccgcccaacuuccccaccgaggggcugagccccucccaggugaccauguucccccacaucaucgucgacgugcgccagcuggagcccgugcucaucccccugccggacguccggaacaacuucuaccacuacaaccagagcaacgacuccacgaucaagcugaucgccaugcucuacacgccccugcgcgccaacaacgcgggcgacgacguguucaccgugagcugccggguccugacccgccccucccccgacuucgacuucaucuuccucgugccgcccaccguggagagccggaccaagcccuucaccguccccauccugaccguggaggagauguccaacagccgcuucccggugccccuggagaagcucuacacgggccccuccagcgccuucgucgugcagccccagaacgggcggugcaccaccgacggcguccugcuggggaccacgcagcucuccgccgugaacaucugcaccuuccgcggcgacgugacccacaucgccggcagccacgacuacaccaugaaccuggccucccagaacuggaacaacuacgacccgacggaggagauccccgcgccccuggggaccccggacuucgucggcaagauccagggggugcucacccagaccacgcgggaggacggcagcacccgcgcccacaaggccaccgugagcaccggguccguccacuucacgcccaagcugggcagcgugcaguacaccaccgacaccaacaacgacuuccagacgggccagaacaccaaguucacccccgugggggucauccaggacggcuccaaccaccagaacgagccccagcagugggugcugccgaacuacagcgggcggaccggccacaacgugcaccucgcccccgccgucgcgcccacguuccccggggagcagcugcuguucuuccgcuccaccaugccgggcugcagcggcuaccccaacaugaaccucgacugccugcugccccaggagugggugcagcacuucuaccaggaggccgcccccgcccaguccgacguggcgcuccugcgguucgucaacccggacaccgggcgcgugcuguucgagugcaagcuccacaagagcggcuacgugaccgucgcccacaccgggccccacgaccuggugaucccgcccaacggcuacuuccgguucgacuccugggugaaccaguucuacacgcuggcccccauggggaacggcgccggccgcagcuccgcccucuga

SEQ ID NO: 10652 - RNA, 1620 nt, Artificial Sequence
  derived and/or modified sequence opt1 from capsid_protein__Norovirus__BAF74513
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccgugccccuggagaagcucuacaccggccccagcuccgccuucgucgugcagccgcagaacgggcgcugcacgaccgacggcguccugcuggggaccacccagcucagcgccgugaacaucugcacguuccggggcgacgugacccacaucgccggcucccacgacuacaccaugaaccuggccagccagaacuggaacaacuacgaccccaccgaggagauccccgcgccgcuggggacgcccgacuucgucggcaagauccagggggugcucacccagaccacccgcgaggacggcagcacgcgggcccacaaggccaccguguccaccgggagcguccacuucacccccaagcugggcuccgugcaguacacgaccgacaccaacaacgacuuccagaccggccagaacacgaaguucacccccgugggggucauccaggacggcagcaaccaccagaacgagccgcagcagugggugcugcccaacuacuccgggcgcaccggccacaacgugcaccucgcccccgccgucgcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacguggcgcuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcgccggccggcgccgggcccucuga

SEQ ID NO: 10653 - RNA, 1623 nt, Artificial Sequence
  derived and/or modified sequence opt1 from capsid_protein__Norovirus__BAF74514
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcacccugcggggcgacgugacccacaucgccgggacccacaacuacacgaugaaccuggccucccagaacuggaacaacuacgacccgaccgaggagauccccgcgccccucggcacccccgacuucguggggcgcauccagggcguccugacccagacgacccgcggggacggcagcacccggggccacaaggccaccguguccacgggggacgugcacuucaccccgaagcugggcagcguccaguucaacaccgacaccaacaacgacuucgagaucgggcagaacacgcgguucacccccgugggcgugguccaggacgggaacggcacccaccagaacgagccccagcagugggugcuccccuccuacagcggccgcaccgggcacaacgugcaccuggccccggccgucgcccccacguuccccggcgagcagcuccucuucuuccggagcaccaugcccgggugcuccggcuacccgaacaugaaccuggacugccugcucccccaggagugggugcagcacuucuaccaggaggccgcgcccgcccagagcgacguggcccugcugcgcuucgucaaccccgacaccgggcggguccucuucgagugcaagcugcacaaguccggcuacgugaccguggcccacaccggccagcacgaccuggugaucccgcccaacggguacuuccgcuucgacagcugggugaaccaguucuacacgcucgcgcccaugggcaacgggaccggccggcgccgcgcccuguga

SEQ ID NO: 10654 - RNA, 1620 nt, Artificial Sequence
  derived and/or modified sequence opt1 from capsid_protein__Norovirus__BAF74515
augaagauggccagcaacgacgccaaccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccugagccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaggcccacgacuccacccugaagcucaucgccaugcuguacacgccccugcgggcgaacaacgccggcgacgacguguucaccgugagcugccgcguccucacccggcccuccccggacuucgacuucaucuuccuggugccgcccaccguggagagccgcaccaagcccuucacgguccccgugcugaccguggaggagaugaccaacucccgguuccccaucccccucgagaagcuguacaccggccccagcuccgccaucgucgugcagccgcagaacgggcgcugcacgaccgacggcguccugcucgggaccacccagcugagcgccgugaacaucugcacguuccggggcgacgugacccacaucgccggcucccgcaacuacaccaugaaccuggcgagccagaacuggaacaacuacgaccccaccgaggagauccccgccccgcucgggacgcccgacuucgucggcaagauccaggggcugcugacccagaccacccgggccgacggcuccacgcgcgcccacaaggccaccgugagcaccgggagcgugcacuucacccccaagcucggcuccguccaguucagcacggacaccgacaacgacuuccagcccggccagaacaccaaguucaccccggugggggugauccaggacggcgaccggcaccagaacgagccccagcaguggguccugcccgacuucuccgggcgcacgggccacaacgugcaccuggcgcccgccguggccccgaccuuccccggggagcagcuccuguucuuccggagcaccaugcccggccgcuccggcuaccccaacaugaaccuggacugccuccugccgcaggaguggguccugcacuucuaccaggagagcgcccccgcgcaguccgacguggcccuccugcgguucgugaaccccgacaccaaccgcguccuguucgagugcaagcuccacaagagcggguacaucacgguggcccacaccggccaccacgaccugauccugcccccgaacggguacuuccgguucgacuccugggugaaccaguucuacacccucgcccccaugggcaacggggccggccgccgccgggcgcccuga

SEQ ID NO: 10655 - RNA, 1623 nt, Artificial Sequence
  derived and/or modified sequence opt1 from capsid_protein__Norovirus__BAF74516
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucgugcucgccgggaacgccuucaccgcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaaccuguaccacuacaaccagagcaacgaccccacgaucaagcucaucgccaugcuguacacgccccugcgggccaacaacgcgggcgaggacguguucaccgucuccugccgcgugcucacccggccgagccccgacuucgacuucaucuuccuggugccgcccaccgucgagucccgcaccaagcccuucaccgugcccauccugaccggcgaggagaugacgaacagccgguuccccaucccccucgagaagcuguucaccgggccguccggcgccuucgugguccagccccagaacgggcgcugcaccaccgacggcgugcugcucggcacgacccagcugcugcccgucaacaucugcaccuuccgcggggacgugacccacaucgccggcacgcacaacuacaccaugaaccucgccagccagaacuggaacaacuacgacccgaccgaggagauccccgcgccccuggggacccccgacuucgugggccggauccaggggaugcugacgcagaccacccggggcgacggcuccacccgcgggcacaaggccacggucagcaccggcgacgugcacuucaccccgaagcucggguccauccaguucaacaccgacacgaacaacgacuucgagaccggccagaacaccaaguucacccccgugggggucgugcaggacggcaacggcacgcaccagaacgagccccagcagugggugcugcccagcuacuccgggcggaccagccacaacguccaccuggccccggccguggcccccaccuuccccggcgagcagcuccuguucuuccgcagcaccaugcccgggugcuccggcuacccgaacaugaaccuggacugccuccugccccaggagugggugcagcacuucuaccaggaggccgcgcccgcccagagcgacgucgcccugcuccgguucgugaaccccgacaccgggcgcgugcuguucgagugcaagcugcacaaguccggcuacgucacgguggcccacaccggccagcacgaccucgugaucccgcccaacggguacuuccgguucgacagcugggucaaccaguucuacacccuggcgcccaugggcaacgggaccggccgccggcgcgcccuguga

SEQ ID NO: 10656 - RNA, 1623 nt, Artificial Sequence
  derived and/or modified sequence opt1 from capsid_protein__Norovirus__BAF74517
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggacccacaacuacaccaugaaccuggccagccagaacuggaacaacuacgaccccacggaggagaucccggcgccccugggcacccccgacuucguggggcgcauccagggcaugcucacccagaccacgcgcggggacggcuccacccggggccacaaggccaccgucagcaccggggacgugcacuucacgcccaagcugggcuccauccaguucaacaccgacaccaacaacgacuucgagaccgggcagaacacgaaguucaccccggugggcgucgugcaggacgggaacggcgcccaccagaacgagccccagcagugggugcugcccagcuacagcggccggaccgggcacaacguccaccucgcccccgccguggcgccgaccuuccccggcgagcagcugcuguucuuccgcuccacgaugcccgggugcagcggcuaccccaacaugaaccucgacugccugcugccgcaggagugggugcagcacuucuaccaggaggccgcccccgcccaguccgacgucgcgcuccugcgguucgugaaccccgacaccgggcgcgugcuguucgagugcaagcuccacaagagcggcuacgucaccguggcccacaccggccagcacgaccuggugaucccgcccaacggguacuuccgguucgacuccugggucaaccaguucuacacccuggcccccaugggcaacgggacgggccgccggcgcgcccucuga

SEQ ID NO: 10657 - RNA, 1623 nt, Artificial Sequence
  derived and/or modified sequence opt1 from capsid_protein__Norovirus__BAF74518
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcgugcaguucaacaccgacaccaacaacgacuucgagacggggcagaacacccgguucacccccgucggcguggugcaggacgggaacggcacccaccagaacgagccccagcaguggguccugcccuccuacagcggccgcacggggcacaacgugcaccucgccccggccguggcccccaccuuccccggcgagcagcugcuguucuuccggagcaccaugcccgggugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacacgggccagcacgaccuggucaucccgcccaacggguacuuccgcuucgacagcugggugaaccaguucuacacccuggcgcccaugggcaacgggaccggccggcgccgcgcccucuga

SEQ ID NO: 10658 - RNA, 1623 nt, Artificial Sequence
  derived and/or modified sequence opt1 from capsid_protein__Norovirus__BAF74519
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcaccaagcccuucaccguccccauccugaccguggaggagaugacgaacagccgguuccccaucccccuggagaagcuguucaccggcccguccggggccuucgugguccagccccagaacggccgcugcaccaccgacggggugcuccugggcacgacccagcucagccccgucaacaucugcaccuuccggggcgacgugacccacaucgccgggacgcacaacuacaccaugaaccuggccucccagaacuggaacaacuacgacccgaccgaggagauccccgcgccccugggcacccccgacuucguggggcgcauccagggcaugcucacgcagaccacccgcggggacggcagcacccggggccacaaggccacggucuccaccggggacgugcacuucaccccgaagcugggcagcauccaguucaacaccgacacgaacaacgacuucgagaccgggcagaacaccaaguucacccccgugggcgucgugcaggacgggaacggcacgcaccagaacgagccccagcagugggugcugcccuccuacagcggccggaccgggcacaacguccaccucgccccggccguggcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacgucgcccuccugcgguucgugaaccccgacaccgggcgcgugcuguucgagugcaagcuccacaaguccggcuaccugacggucgcccacaccggccagcacgaccuggugaucccgcccaacggguacuuccgguucgacagcugggugaaccaguucuacacccucgcgcccaugggcaacgggaccggccgccggcgcgcccuguga

SEQ ID NO: 10659 - RNA, 1623 nt, Artificial Sequence
  derived and/or modified sequence opt1 from capsid_protein__Norovirus__BAF74520
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucauccaggacgggaacggcgcccaccagaacgagccccagcagugggugcugcccuccuacagcggccggaccgggcacaacgugcaccucgccccggccgucgcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacguggcccuccugcgguucgucaaccccgacaccgggcgcgugcuguucgagugcaagcuccacaaguccggcuacaucaccguggcgcacaccggccagcacgaccuggucaucccgcccaacggguacuuccgguucgacagcugggugaaccaguucuacacgcuggcccccaugggcaacgggaccggccgccggcgcgcccucuga

SEQ ID NO: 10660 - RNA, 1623 nt, Artificial Sequence
  derived and/or modified sequence opt1 from capsid_protein__Norovirus__BAF74521
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccagcuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggggccuucgugguccagccccagaacggccgcugcaccaccgacggggugcuccugggcaccacgcagcucucccccgucaacaucugcaccuuccggggcgacgugacccacaucgccgggacccacaacuacacgaugaaccuggccagccagaacuggaacaacuacgacccgaccgaggagauccccgcgccccugggcacccccgacuucguggggcgcauccagggcaugcucacccagacgacccgcggggacggcuccacccggggccacaaggccaccgucagcacgggggacgugcacuucaccccgaagcugggcuccauccaguucaacaccgacaccaacaacgacuucgagacggggcagaacaccaaguucacccccgugggcgucgugcaggacgggaacggcacccaccagaacgagccccagcagugggugcugcccagcuacagcggccggacggggcacaacguccaccucgccccggccguggcccccaccuuccccggcgagcagcugcuguucuuccgcuccaccaugcccgggugcagcggcuacccgaacaugaaccucgacugccugcugccccaggagugggugcagcacuucuaccaggaggccgcgcccgcccaguccgacgucgcccuccugcgguucgugaaccccgacaccgggcgcgugcuguucgagugcaagcuccacaagagcggcuacgucaccguggcccacacgggccagcacgaccuggugaucccgcccaacggguacuuccgguucgacuccugggucaaccaguucuacacccuggcgcccaugggcaacgggaccggccgccggcgcgcccucuga

SEQ ID NO: 10661 - RNA, 1623 nt, Artificial Sequence
  derived and/or modified sequence opt1 from capsid_protein__Norovirus__BAF74522
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccagcuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcaccaagcccuucaccguccccauccugaccguggaggagaugacgaacucccgguuccccaucccccuggagaagcuguucaccggcccgagcggggccuucgugguccagccccagaacggccgcugcaccaccgacggggugcuccugggcacgacccagcucucccccgucaacaucugcaccuuccggggcgacgugacccacaucgccgggacgcacaacuacaccaugaaccuggccagccagaacuggaacaacuacgacccgaccgaggagauccccgcgccccugggcacccccgacuucguggggcgcauccagggcaugcucacgcagaccacccgcggggacggcuccacccggggccacaaggccacggucagcaccggggacgugcacuucaccccgaagcugggcuccgugcaguucgacaccgacacgaacagcgacuucgagaccgggcagaacaccaaguucacccccgucggcguggugcaggacgggaacggcgcccaccagaacgagccccagcaguggguccugcccagcuacuccggccggacggggcacaacgcccaccucgccccggccguggcgcccaccuuccccggcgagcagcugcuguucuuccgcagcaccaugcccgggugcuccggcuacccgaacaugaaccucgacugccugcugccccaggagugggugcagcacuucuaccaggaggccgcccccgcccagagcgacgucgcgcuccugcgguucgugaaccccgacaccgggcgcgugcuguucgagugcaagcuccacaaguccggcuacgucaccguggcccacacgggccagcacgaccuggugaucccgcccaacggguacuuccgguucgacagcugggucaaccaguucuacacccuggcccccaugggcaacgggaccggccgccggcgcgcccucuga

SEQ ID NO: 10662 - RNA, 1623 nt, Artificial Sequence; identical to SEQ ID NO: 9307
  derived and/or modified sequence opt1 from capsid_protein__Norovirus__BAF74523

SEQ ID NO: 10663 - RNA, 1623 nt, Artificial Sequence; identical to SEQ ID NO: 9307
  derived and/or modified sequence opt1 from capsid_protein__Norovirus__BAF74524

SEQ ID NO: 10664 - RNA, 1623 nt, Artificial Sequence; identical to SEQ ID NO: 9307
  derived and/or modified sequence opt1 from capsid_protein__Norovirus__BAF74525

SEQ ID NO: 10665 - RNA, 1623 nt, Artificial Sequence
  derived and/or modified sequence opt1 from capsid_protein__Norovirus__BAF74526
augaagauggccagcaacgacgccacccccuccgacggcagcaccgcgaaccuggugccggaggucaacacggaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugacgauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcggaccaacaacgccggcgacgacguguucaccguguccugccgcguccugacccggccgagccccgacuucgacuucaucuuccucgugccgcccaccguggagucccgcaccaagcccuucagcguccccauccugacgguggaggagaugaccaacucccgguuccccaucccccuggagaagcuguucaccggcccgagcuccgcguucgugguccagccccagaacgggcgcugcaccacggacggcgugcuccuggggaccacccagcucagccccgucaacaucugcaccuuccggggcgacgugacgcacaucgccggcacccagaacuacaccaugaaccuggccucccagaacuggaacaacuacgacccgaccgaggagauccccgcgccccuggggacgcccgacuucgugggcaagauccaggggguccucacccagaccacccgccgggacggcagcacgcgcgggcacaaggccaccguguccaccggcagcauccacuucaccccgaagcugggcagcgugcaguucuccacggacaccagcaacgacuucgagaccgggcagaacacccgguucacgcccgucggcguggugcaggacggguccaccacccaccagaacgagccccagcaguggguccugcccgacuacagcggccgcgacucccacaacgugcaccucgccccggccguggcccccaccuuccccggggagcagcugcuguucuuccggagcaccaugcccggcugcuccggcuacccgaacaugaaccucgacugccugcugccccaggaguggguccagcacuucuaccaggagagcgcccccgcccaguccgacguggcgcuccugcgcuucgugaaccccgacacggggcggguccuguucgagugcaagcuccacaagagcggcuacgugaccguggcccacaccgggcagcacgaccuggucaucccgcccaacggcuacuuccgcuucgacuccugggugaaccaguucuacacccuggcccccauggggaacggcgccggccggcgccgcgcgcucuga

SEQ ID NO: 10666 - RNA, 1623 nt, Artificial Sequence
  derived and/or modified sequence opt1 from capsid_protein__Norovirus__BAF74527
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcauccacuucaccccgaagcugggcagcgugcaguucuccaccgacaccagcaacgacuucgagacggggcagaacacccgguucacccccgucggcguggugcaggacggguccaccacgcaccagaacgagccccagcaguggguccugcccgacuacagcggccgcgacucccacaacgugcaccucgccccggccguggcccccaccuuccccggggagcagcugcuguucuuccggagcaccaugcccggcugcuccggcuacccgaacaugaaccucgacugccugcugccccaggaguggguccagcacuucuaccaggagagcgcccccgcgcaguccgacguggcccuccugcgcuucgugaaccccgacaccgggcggguccuguucgagugcaagcuccacaagagcggcuacgugaccguggcccacacggggcagcacgaccuggucaucccgcccaacggcuacuuccgcuucgacuccugggugaaccaguucuacacccuggcccccauggggaacggcgcgggccggcgccgcgcccucuga

SEQ ID NO: 10667 - RNA, 1620 nt, Artificial Sequence
  derived and/or modified sequence opt1 from capsid_protein__Norovirus__BAF95499
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccgugccccuggagaagcucuacaccggccccuccagcgccuucgucgugcagccgcagaacgggcgcugcacgaccgacggcguccugcuggggaccacccagcucuccgccgugaacaucugcacguuccggggcgacgugacccacaucgccggcagccacgacuacaccaugaaccuggccucccagaacuggaacaacuacgaccccaccgaggagauccccgcgccgcuggggacgcccgacuucgucggcaagauccagggggugcucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcuccaaccaccagaacgagccgcagcagugggugcugcccaacuacagcgggcgcaccggccacaacgugcaccucgcccccgccgucgcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacguggcgcuccugcgcuucgucaaccccgacaccgggcgggugcuguucgagugcaagcuccacaagagcggcuacgugaccgucgcccacaccgggccccacgaccuggugaucccgcccaacggcuacuuccgcuucgacuccugggugaaccaguucuacacccuggcccccauggggaacggcgccggccggcgccgggcccucuga

SEQ ID NO: 10668 - RNA, 1620 nt, Artificial Sequence
  derived and/or modified sequence opt1 from capsid_protein__Norovirus__BAF95501
augaagauggccagcaacgacgugaaccccuccgacggcagcgccgcgaaccuggucccggaggugaacaacgaggugauggcccucgagcccgucgugggggccgccaucgccgcgcccguggccggccagcagaacaucaucgaccccuggauccgcaacaacuucguccaggcccccgggggcgaguucaccgugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgcggccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggccaacaacgcgggcgacgacguguucaccgucagcugccgcgugcucacccggcccuccccggacuucgacuucaucuuccuggugccgcccaccgucgagagccgcaccaagcccuucacggugcccgugcugaccgucgaggagaugaccaacucccgguuccccaucccccucgagaagcuguacaccggccccagcuccgccuucgugguccagccgcagaacgggcgcugcacgaccgacggcgugcugcucgggaccacccagcugagcgccgugaacaucugcacguuccggggcgacgucacccacaucgccggcucccgcaacuacaccaugaaccuggccagccagaacuggaacaacuacgaccccaccgaggagauccccgcgccgcucgggacgcccgacuucgugggcaagauccaggggcugcugacccagaccacccgggccgacggcuccacgcgcgcccacaaggccaccgugagcaccgggagcguccacuucacccccaagcucggcuccgugcaguucagcacggacaccgacaacgacuuccagcccggccagaacaccaaguucaccccggugggggucauccaggacggcgaccggcaccagaacgagccccagcagugggugcugcccgacuacuccgggcgcacgggccacaacgugcaccuggcccccgcggucgccccgaccuuccccggggagcagcuccuguucuuccggagcaccaugcccggcugcuccggcuaccccaacaugaaccuggacugccuccugccgcaggagugggugcugcacuucuaccaggagagcgcccccgcccaguccgacguggcgcuccugcgcuucgucaaccccgacaccaaccgggugcuguucgagugcaagcuccacaagagcggguacaucacgguggcccacaccggccagcacgaccugauccugcccccgaacggguacuuccgcuucgacuccugggucaaccaguucuacacccucgcccccaugggcaacggggccggccggcgccgcgcccccuga

SEQ ID NO: 10669 - RNA, 1623 nt, Artificial Sequence
  derived and/or modified sequence opt1 from capsid_protein__Norovirus__BAF95503
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgaccaagggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccgcacggggcacaacguccaccucgccccggccguggcccccaccuuccccggcgagcagcugcuguucuuccggagcaccaugcccgggugcuccggcuacccgaacaugaaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacacgggccagcacgaccuggugaucccgcccaacggguacuuccgcuucgacagcugggucaaccaguucuacacccuggcgcccaugggcaacgggaccggccggcgccgggcccucuga

SEQ ID NO: 10670 - RNA, 1623 nt, Artificial Sequence
  derived and/or modified sequence opt1 from capsid_protein__Norovirus__BAF95505
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccgugcugaccguggaggagaugaccaacagccgguuccccaucccccuggagaagcuguucacgggcccguccggggccuucgucgugcagccccagaacggccgcugcaccaccgacgggguccuccugggcaccacgcagcucagccccgugaacaucugcaccuuccggggcgacgugacccacaucgccgggacccacaacuacacgaugaaccuggccucccagaacuggaacaacuacgacccgaccgaggagauccccgcgccccugggcacccccgacuucgucgggcgcauccagggcaugcucacccagacgaccaagggggacggcagcacccggggccacaaggccaccguguccacgggggacgugcacuucaccccgaagcugggcagcauccaguucaacaccgacaccaacaacgacuucgagacggggcagaacaccaaguucacccccgucggcguggugcaggacgggaacggcacccaccagaacgagccccagcaguggguccugcccuccuacagcggccgcacggggcacaacgugcaccucgccccggccguggcccccaccuuccccggcgagcagcugcuguucuuccggagcaccaugcccgggugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacacgggccagcacgaccuggucaucccgcccaacggguacuuccgcuucgacagcugggugaaccaguucuacacccuggcgcccaugggcaacgggaccggccggcgccgggcccucuga

SEQ ID NO: 10671 - RNA, 1623 nt, Artificial Sequence; identical to SEQ ID NO: 10644
  derived and/or modified sequence opt1 from capsid_protein__Norovirus__BAF95507

SEQ ID NO: 10672 - RNA, 1623 nt, Artificial Sequence
  derived and/or modified sequence opt1 from capsid_protein__Norovirus__BAF95509
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccguguccacgggcagcgugcacuucaccccgaagcuggggagcguccaguucuccaccgacaccagcaacgacuucgagacgggccagaacacccgcuucacccccgugggggugguccaggacggcuccaccacgcaccagaacgagccccagcagugggugcugcccaacuacagcgggcgggacucccacaacgugcaccucgccccggccgucgcccccaccuuccccggcgagcagcugcuguucuuccgcagcaccaugcccggcugcuccggguacccgaacaugaaccucgacugccugcugccccaggagugggugcagcacuucuaccaggagagcgcccccgcgcaguccgacguggcccuccugcgguucgucaaccccgacaccggccgcgugcuguucgagugcaagcuccacaagagcggguacgugaccgucgcccacacgggccagcacgaccuggugaucccgcccaacggguacuuccgguucgacuccugggugaaccaguucuacacccuggcccccaugggcaacggcgcggggcgccggcgcgcccucuga

SEQ ID NO: 10673 - RNA, 1623 nt, Artificial Sequence; identical to SEQ ID NO: 9329
  derived and/or modified sequence opt1 from capsid_protein__Norovirus__BAF95511

SEQ ID NO: 10674 - RNA, 1623 nt, Artificial Sequence
  derived and/or modified sequence opt1 from capsid_protein__Norovirus__BAF95513
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgacccgccgggacggcuccacccgcgggcacaaggccaccgugagcacgggcagcgugcacuucacccccaagcugggcuccguccaguucagcaccgacaccuccaacgacuucgagacggggcagaacacccgguucaccccggugggcgugguccaggacgggagcaccacgcaccagaacgagccccagcagugggugcugcccaacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcaagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcgcccucuga

SEQ ID NO: 10675 - RNA, 1623 nt, Artificial Sequence; identical to SEQ ID NO: 9155
  derived and/or modified sequence opt1 from capsid_protein__Norovirus__BAF95515

SEQ ID NO: 10676 - RNA, 1623 nt, Artificial Sequence
  derived and/or modified sequence opt1 from capsid_protein__Norovirus__BAF95517
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcuccuggggaccacccagcucucccccgucaacaucugcacguuccggggcgacgugacccacaucagcggcacccgcaccuaccggaugaaccuggccucccagaacuggaacaacuacgaccccacggaggagaucccggcgccccuggggacccccgacuucgugggcaagauccaggggaugcucacccagaccacgaagggcgacgggagcacccgcggccacaaggccaccgucagcaccggcuccguggacuucacgcccaagcuggggagcgugcaguucgccaccgacaccgacaacgacuucgagaccggccagaacacgcgguucaccccggucggggugauccaggacggcuccagcgcccaccgcaacgagccccagcagugggugcugcccgacuacuccgggcggaccguccacaacgugcaccucgcccccgccguggcgccgaccuuccccggcgagcagcugcuguucuuccgcagcacgaugcccggcugcuccggguaccccaacauggaccucgacugccugcugccgcaggaguggguccagcacuucuaccaggaggccgcccccagccaguccgacguggcccuccugcgguucgugaaccccgacaccggccgcguccuguucgagugcaagcuccacaaggcgggguacgugaccguggcccacaccggccagcacgaccuggucaucccgcccaacggguacuuccgguucgacagcugggugaaccaguucuacacccuggcccccaugggcaacggcgccgggcgccgccgggcccucuga

SEQ ID NO: 10677 - RNA, 1623 nt, Artificial Sequence
  derived and/or modified sequence opt1 from capsid_protein__Norovirus__BAF95519
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgaccacccgcgacggcuccacccgggggcacaaggccacggugagcaccggcagcgugcacuucacccccaagcugggcuccguccaguucagcaccgacacguccaacgacuucgagaccgggcagaacacccgcuucaccccggugggcgugguccaggacgggagcacgacccaccagaacgagccccagcagugggugcugcccgacuacuccggccgggacagccacaacgugcaccucgcccccgccgucgccccgaccuuccccggggagcagcugcuguucuuccgcuccaccaugcccggcugcagcggcuaccccaacaugaaccucgacugccugcugccgcaggagugggugcagcacuucuaccaggaguccgcccccgcgcagagcgacguggcccuccugcgguucgucaaccccgacaccgggcgcgugcuguucgagugcaagcuccacaaguccggcuacgugacggucgcccacaccgggcagcacgaccuggugaucccgcccaacggcuacuuccgguucgacagcugggugaaccaguucuacacccuggcccccauggggaacggcgcgggccgccggcgcgcccucuga

SEQ ID NO: 10678 - RNA, 1623 nt, Artificial Sequence
  derived and/or modified sequence opt1 from capsid_protein__Norovirus__BAF95521
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcgggaccacccaccagaacgagccccagcaguggguccugcccaacuacagcggccgggacucccacaacgugcaccucgccccggccguggcccccagcuuccccggggagcagcugcuguucuuccgcuccacgaugcccggcugcagcggcuacccgaacaugaaccucgacugccugcugccccaggaguggguccagcacuucuaccaggaggccgcgcccgcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgggcccucuga

SEQ ID NO: 10679 - RNA, 1623 nt, Artificial Sequence; identical to SEQ ID NO: 9855
  derived and/or modified sequence opt1 from capsid_protein__Norovirus__BAF95523

SEQ ID NO: 10680 - RNA, 1623 nt, Artificial Sequence; identical to SEQ ID NO: 9155
  derived and/or modified sequence opt1 from capsid_protein__Norovirus__BAF95525

SEQ ID NO: 10681 - RNA, 1623 nt, Artificial Sequence
  derived and/or modified sequence opt1 from capsid_protein__Norovirus__BAF95527
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgacgugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccacccaccgcaacgagccccagcagugggugcugcccgacuacagcgggcggacgguccacaacgugcaccucgccccggccguggcccccaccuuccccggcgagcagcugcuguucuuccgcuccaccaugcccggcugcagcggguacccgaacauggaccucgacugccugcugccccaggaguggguccagcacuucuaccaggaggccgcgcccucccagagcgacguggcccuccugcgguucgugaaccccgacaccggccgcguccuguucgagugcaagcuccacaaggccggguacgugaccguggcccacacgggccagcacgaccuggucaucccgcccaacggguacuuccgguucgacuccugggugaaccaguucuacacccuggcgcccaugggcaacggcgccgggcgccgccgggcccucuga

SEQ ID NO: 10682 - RNA, 1623 nt, Artificial Sequence
  derived and/or modified sequence opt1 from capsid_protein__Norovirus__BAF95529
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcaugcugacccagaccaccaagggggacggcagcacgcggggccacaaggccaccgucuacaccggguccgcccccuucaccccgaagcugggcagcgugcaguucagcacggacaccgagaacgacuucgagacccaccagaacaccaaguucacgcccgugggggucauccaggacggcuccaccacccaccgcaacgagccccagcagugggugcuccccagcuacuccgggcggaacgugcacaacguccaccuggccccggccguggcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 10683 - RNA, 1623 nt, Artificial Sequence; identical to SEQ ID NO: 9292
  derived and/or modified sequence opt1 from capsid_protein__Norovirus__BAF95531

SEQ ID NO: 10684 - RNA, 1623 nt, Artificial Sequence; identical to SEQ ID NO: 9996
  derived and/or modified sequence opt1 from capsid_protein__Norovirus__BAG30923

SEQ ID NO: 10685 - RNA, 1629 nt, Artificial Sequence
  derived and/or modified sequence opt1 from capsid_protein__Norovirus__BAG34630
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcagaacgcggccgggcacaacgagcccgccaaccggggccacgacgccguggugcccacguacaccgcccaguacacccccaagcugggccagauccagaucgggaccuggcagacggacgaccugaccgucaaccagccggugaaguucacccccgugggccucaacgacaccgagcacuucaaccagugggucgugccccgcuacgcgggggcccugaaccugaacacgaaccucgcccccuccguggccccggucuuccccggcgagcggcugcuguucuuccgcagcuacaucccccucaagggcggguacggcaaccccgcgaucgacugccugcugccgcaggagugggugcagcacuucuaccaggaggccgcccccagcauguccgagguggcccucguccgguacaucaaccccgacaccgggcgcgcccuguucgaggcgaagcugcaccgggccggcuucaugaccgugagcuccaacaccagcgcccccguggucgugccggccaacggguacuuccgcuucgacuccugggugaaccaguucuacagccucgcccccaugggcacggggaacggccggcgccgcguccaguga

SEQ ID NO: 10686 - RNA, 1629 nt, Artificial Sequence
  derived and/or modified sequence opt1 from capsid_protein__Norovirus__BAG34632
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguucaccucccccaacgaggugaucagcgugcagugccagaacgggcgcugcacccucgacggcgagcugcaggggaccacgcagcugcaggucuccggcaucugcguguucaagggcgaggucaccgcccaccuccacgacaacgaccaccuguacaacaucaccaucaccaaccugaacgggagccccuucgacccguccgaggacgugcccgcgccccucggcgugccggacuuccaggggcgggucuucggcgugaucagccagcgcgacaaccacaacgccuccgggcacaaccagcccgcgaaccggggccacgacgccgugguccccacguacaccgcccaguacacccccaagcugggccagauccagaucgggaccuggcagacggacgaccugaccgugaaccagccggugaaguucacccccgucggccucaacgacguggagcacuucaaccaguggguggucccccgcuacgccggggcccugaaccugaacaccaaccucgcgcccagcguggccccgguguuccccggcgagcggcugcuguucuuccgcagcuaccucccccugaagggcggguacggcaaccccgucaucgacugccugcucccgcaggagugggugcagcacuucuaccaggaggccgcccccuccaugagcgagguggcgcugguccgguacaucaaccccgacacggggcgcgcccuguucgaggccaagcuccaccgggccggcuucaugaccguguccagcaacaccuccgcccccguggucgugccggcgaacggguacuuccgcuucgacagcugggugaaccaguucuacucccuggcccccaugggcaccgggaacggccggcgccgcauccaguga

SEQ ID NO: 10687 - RNA, 1629 nt, Artificial Sequence
  derived and/or modified sequence opt1 from capsid_protein__Norovirus__BAG34634
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacgcgagcgggcacaacgagcccgccaaccggggccacgacgccguggugcccacguacaccgcccaguacacccccaagcugggccagauccagaucgggaccuggcagacggacgaccugaccgucaaccagccggugaaguucacccccgugggccucaacgacaccgagcacuucaaccagugggucgugccccgcuacgccggggcgcugaaccugaacacgaaccucgcccccagcguggccccggucuuccccggcgagcggcugcuguucuuccgcuccuacaucccccucaagggcggguacggcaaccccgccaucgacugccugcugccgcaggagugggugcagcacuucuaccaggaggcggcccccagcauguccgagguggcccucguccgguacaucaaccccgacaccgggcgcgcccuguucgaggccaagcugcaccgggcgggcuucaugaccgugagcuccaacaccagcgcccccguggucgugccggccaacggguacuuccgcuucgacuccugggugaaccaguucuacagccucgcccccaugggcacggggaacggccggcgccgcguccaguga

SEQ ID NO: 10688 - RNA, 1629 nt, Artificial Sequence
  derived and/or modified sequence opt1 from capsid_protein__Norovirus__BAG34636
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguucaccucccccaacgaggugaucagcgugcagugccagaacgggcgcugcacccucgacggcgagcugcagggguccacccagcugcaggucagcggcaucugcgccuucaagggcgaggugacggcccaccuccacgacaacgaccaccuguacaacaucaccaucaccaaccugaacgggucccccuucgacccgagcgaggacguccccgcgccccucggcgugccggacuuccaggggcggguguucggcgucaucucccagcgcgacaaccacaacgcgagcgggcacaaccagcccgccaaccggggccacgacgccguggugcccaccuacacgagccaguacacccccaagcugggccagauccagaucgggaccuggcagaccgacgaccugacggucaaccagccggugaaguucacccccgugggccucaacgacgucgagcacuucaaccaguggguggugccccgcuacgccggggcccugaaccugaacaccaaccucgcgcccuccgucgccccgguguuccccggcgagcggcugcuguucuuccgcagcuaccucccccugaagggcggguacggcaaccccgccaucgacugccugcucccgcaggagugggugcagcacuucuaccaggaggccgcgcccuccaugagcgaggucgcccuggugcgguacaucaaccccgacaccgggcgcgcccuguucgaggccaagcuccaccgggccggcuucaugacgguguccagcaacaccuccgcgcccgucguggugccggccaacggguacuuccgcuucgacagcugggucaaccaguucuacucccuggcccccaugggcaccgggaacggccggcgccgcauccaguga

SEQ ID NO: 10689 - RNA, 1629 nt, Artificial Sequence; identical to SEQ ID NO: 9228
  derived and/or modified sequence opt1 from capsid_protein__Norovirus__BAG34638

SEQ ID NO: 10690 - RNA, 1629 nt, Artificial Sequence; identical to SEQ ID NO: 9228
  derived and/or modified sequence opt1 from capsid_protein__Norovirus__BAG34640

SEQ ID NO: 10691 - RNA, 1629 nt, Artificial Sequence; identical to SEQ ID NO: 9228
  derived and/or modified sequence opt1 from capsid_protein__Norovirus__BAG34642

SEQ ID NO: 10692 - RNA, 1629 nt, Artificial Sequence; identical to SEQ ID NO: 9228
  derived and/or modified sequence opt1 from capsid_protein__Norovirus__BAG34644

SEQ ID NO: 10693 - RNA, 1629 nt, Artificial Sequence; identical to SEQ ID NO: 9228
  derived and/or modified sequence opt1 from capsid_protein__Norovirus__BAG34646

SEQ ID NO: 10694 - RNA, 1629 nt, Artificial Sequence
  derived and/or modified sequence opt1 from capsid_protein__Norovirus__BAG34648
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggagcacccagcugcaggucuccggcaucugcgccuucaagggcgaggugacggcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacagccccgggcacaacgagcccgcgaaccggggccacgacgccguggugcccaccuacacgucccaguacaccccgaagcugggccagauccagaucgggaccuggcagaccgacgaccugacggucaaccagcccgugaaguucacccccgugggccucaacgacaccgagcacuucaaccagugggucgugccccgcuacgccggggcccugaaccugaacaccaaccucgccccgagcguggcgcccgucuuccccggcgagcggcugcuguucuuccgcuccuacaucccccucaagggcggguacggcaacccggccaucgacugccugcugccccaggagugggugcagcacuucuaccaggaggccgcccccagcauguccgagguggcgcucguccgguacaucaaccccgacacggggcgcgcccuguucgaggccaagcugcaccgggccggcuucaugaccgugagcuccaacaccagcgccccgguggucgugcccgcgaacggguacuuccgcuucgacuccugggugaaccaguucuacagccucgcccccaugggcaccgggaacggccggcgccgcguccaguga

SEQ ID NO: 10695 - RNA, 1629 nt, Artificial Sequence; identical to SEQ ID NO: 9228
  derived and/or modified sequence opt1 from capsid_protein__Norovirus__BAG34650

SEQ ID NO: 10696 - RNA, 1629 nt, Artificial Sequence
  derived and/or modified sequence opt1 from capsid_protein__Norovirus__BAG34652
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacucccccgggcacaacgagcccgcgaaccggggccacgacgccguggugcccacguacaccccgcaguacacccccaagcugggccagauccagaucgggaccuggcagacggacgaccugaccgucaaccagcccgugaaguucacccccgugggccucaacgacaccgagcacuucaaccagugggucgugccgcgcuacgccggggcccugaaccugaacacgaaccucgcccccagcguggcgcccgucuuccccggcgagcggcugcuguucuuccgcagcuacaucccgcucaagggcggguacggcaaccccgccaucgacugccugcugccccaggagugggugcagcacuucuaccaggaggccgcccccuccaucagcgagguggcgcucguccgguacaucaacccggacaccgggcgcgcccuguucgaggccaagcugcaccgggccggcuucaugaccguguccagcaacaccuccgcccccguggucgugcccgcgaacggguacuuccgcuucgacagcugggugaaccaguucuacucccucgcccccaugggcacggggaacggccggcgccgcguccaguga

SEQ ID NO: 10697 - RNA, 1629 nt, Artificial Sequence
  derived and/or modified sequence opt1 from capsid_protein__Norovirus__BAG34654
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacucccccgggcacaacgagagcgcgaaccggggccacgacgccguggugcccacguacaccagccaguacacccccaagcugggccagauccagaucgggaccuggcagacggacgaccugaccgucaaccagccggugaaguucacccccgugggccucaacgacaccgagcacuucaaccagugggucgugccccgcuacgccggggcccugaaccugaacacgaaccucgcccccuccguggcgccggucuuccccggcgagcggcugcuguucuuccgcagcuacaucccccucaagggcggguacggcaaccccgccaucgacugccugcugccgcaggagugggugcagcacuucuaccaggaggccgcccccuccaugagcgagguggcgcucguccgguacaucaaccccgacaccgggcgcgcccuguucgaggccaagcugcaccgggccggcuucaugaccguguccagcaacaccuccgcccccguggucgugccggcgaacggguacuuccgcuucgacagcugggugaaccaguucuacucccucgcccccaugggcacggggaacggccggcgccgcguccaguga

SEQ ID NO: 10698 - RNA, 1629 nt, Artificial Sequence
  derived and/or modified sequence opt1 from capsid_protein__Norovirus__BAG34656
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacucccccgggcacaacgagcccgcgaaccggggccacgacgccguggugcccacguacaccagccaguacaccccgaagcugggccagauccagaucgggaccuggcagacggacgaccugaucgucaaccagcccgugaaguucacccccgugggccucaacgacaccgagcacuucaaccagugggucgugccccgcuacgccggggcccugaaccugaacaccaaccucgccccgagcguggcgcccgucuuccccggcgagcggcugcuguucuuccgcuccuacaucccccucaagggcggguacggcaacccggccaucgacugccugcugccccaggagugggugcagcacuucuaccaggaggccgcccccagcauguccgagguggcgcucguccgguacaucaaccccgacacggggcgcgcccuguucgaggccaagcugcaccgggccggcuucaugaccgugagcuccaacaccagcgccccgguggucgugcccgcgaacggguacuuccgcuucgacuccugggugaaccaguucuacagccucgcccccaugggcaccgggaacggccggcgccgcguccaguga

SEQ ID NO: 10699 - RNA, 1629 nt, Artificial Sequence; identical to SEQ ID NO: 9228
  derived and/or modified sequence opt1 from capsid_protein__Norovirus__BAG34658

SEQ ID NO: 10700 - RNA, 1629 nt, Artificial Sequence
  derived and/or modified sequence opt1 from capsid_protein__Norovirus__BAG34662
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcagcaacuucguccaggcgccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccagaacgacgaccaccuguacaacaucaccaucaccaaccugaacgggagccccuucgacccguccgaggacauccccgcgccccucggcgucccggacuuccaggggcggguguucggcgugaucacgcagcgcgacaagcagaacgccaccgggcagaaccagcccgccaaccggggccacgacgccgucgugcccaccuacaccgcccaguacacgcccaagcugggccagauccagaucgggaccuggcagaccgacgaccugaaggugaaccagccggucaaguucacccccgugggccucaacgacacggagcacuucaaccaguggguggucccccgcuacgccggggcccugaaccugaacaccaaccucgcgcccagcguggccccgguguuccccggcgagcggcugcuguucuuccgcagcuaccucccccugaagggcggguacggcaaccccgccaucgacugccugcucccgcaggaguggguccagcacuucuaccaggaggccgcgcccuccaugagcgagguggcccuggugcgguacaucaaccccgacaccgggcgcgcccuguucgaggccaagcuccaccgggccggcuucaugaccgucuccagcaacacguccgcgcccgugguggucccggccaacggguacuuccgcuucgacagcugggugaaccaguucuacucccuggcccccaugggcaccgggaacggccggcgccgcauccaguga

SEQ ID NO: 10701 - RNA, 1629 nt, Artificial Sequence
  derived and/or modified sequence opt1 from capsid_protein__Norovirus__BAG34664
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacacgcccgcgccccucggcgucccggacuuccaggggcggguguucggcaucaucagccagcgcgacaagcagaacgcgaccgggcacaacgagcccgccaaccggggccacgacgccgugguccccaccuacaccgcccaguacacgcccaagcugggccagauccagaucgggaccuggcagaccgacgaccugaccgugaaccagccggugaaguucacgcccgucggccucaacgacaccgagcacuucaaccaguggguggugccccgcuacgccggggcgcugaaccugaacaccaaccucgcccccuccgucgccccgguguuccccggcgagcggcugcuguucuuccgcagcuacaucccccucaagggcggguacggcaaccccgccaucgacugccugcugccgcaggagugggugcagcacuucuaccaggaggcggcccccagcauguccgaggucgcccucgugcgguacaucaaccccgacaccgggcgcgcccuguucgaggccaagcugcaccgggcgggcuucaugacggugagcuccaacaccagcgcccccgucguggugccggccaacggguacuuccgcuucgacuccugggucaaccaguucuacagccucgcccccaugggcaccgggaacggccggcgccgcgugcaguga

SEQ ID NO: 10702 - RNA, 1629 nt, Artificial Sequence; identical to SEQ ID NO: 9228
  derived and/or modified sequence opt1 from capsid_protein__Norovirus__BAG34666

SEQ ID NO: 10703 - RNA, 1629 nt, Artificial Sequence
  derived and/or modified sequence opt1 from capsid_protein__Norovirus__BAG34668
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggauccucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccacgguggaguccaagaccaagcccuucacccugcccauccucacccugggcgagcugagcaacucccgguuccccgucagcaucgaccagauguacacgucccccaacgaggugaucagcgugcagugccagaacgggcgcugcacccucgacggcgagcugcaggggaccacccagcugcaggucuccggcaucugcgccuucaagggcgaggugacggcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacucccccgggcacaacgagcccgcgaaccggggccacgacgccguggugcccaccuacacgagccaguacaccccgaagcugggccagauccagaucgggaccuggcagaccgacgaccugacggucaaccagcccgugaaguucacccccgugggccucaacgacaccgagcacuucaaccagugggucgugccccgcuacgccggggcccugaaccugaacaccaaccucgccccgagcguggcgcccgucuuccccggcgagcggcugcuguucuuccgcuccuacaucccccucaagggcggguacggcaacccggccaucgacugccugcugccccaggagugggugcagcacuucuaccaggaggccgcccccagcauguccgagguggcgcucguccgguacaucaaccccgacacggggcgcgcccuguucgaggccaagcugcaccgggccggcuucaugaccgugagcuccaacaccagcgccccgguggucgugcccgcgaacggguacuuccgcuucgacuccugggugaaccaguucuacagccucgcccccaugggcaccgggaacggccggcgccgcguccaguga

SEQ ID NO: 10704 - RNA, 1629 nt, Artificial Sequence
  derived and/or modified sequence opt1 from capsid_protein__Norovirus__BAG34670
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggagcacccagcugcaggucuccggcaucugcgccuucaagggcgaggugacggcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacagccccgggcacaacgagcccgcgaaccggggccacgacgccguggugcccaccuacacgucccaguacaccccgaagcugggccagauccagaucgggaccuggcagaccgacgaccugacggucaaccagcccgccaaguucacccccgugggccucaacgacaccgagcacuucaaccaguggguggucccccgcuacgccggggcccugaaccugaacaccaaccucgcgccgagcguggcccccguguuccccggcgagcggcugcuguucuuccgcuccuacaucccccucaagggcggguacggcaacccggccaucgacugccugcugccccaggaguggguccagcacuucuaccaggaggccgcgcccagcauguccgagguggcccucgugcgguacaucaaccccgacacggggcgcgcccuguucgaggccaagcugcaccgggccggcuucaugaccgucagcuccaacaccagcgcgccgguggugguccccgccaacggguacuuccgcuucgacuccugggugaaccaguucuacagccucgcccccaugggcaccgggaacggccggcgccgcgugcaguga

SEQ ID NO: 10705 - RNA, 1623 nt, Artificial Sequence
  derived and/or modified sequence opt1 from capsid_protein__Norovirus__BAG55289
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccuccuacagcgggcggaacaaccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgggcccucuga

SEQ ID NO: 10706 - RNA, 1629 nt, Artificial Sequence
  derived and/or modified sequence opt1 from capsid_protein__Norovirus__BAG68707
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgucccggacuuccaggggcggguguucggcaucaucagccagcgcgacaagcagaacgcgacggggcacaacgagcccgccaaccggggccacgacguggucgugcccaccuacaccgcccaguacacccccaagcugggccagauccagaucgggacguggcagaccgacgaccugaccgugaaccagccggccaaguucacccccgucggccucaacgacacggagcacuucaaccaguggguggugccccgcuacgccggggcgcugaaccugaacaccaaccucgcccccuccgucgccccgguguuccccggcgagcggcugcuguucuuccgcagcuacaucccccucaagggcggguacggcaaccccgccaucgacugccugcugccgcaggagugggugcagcacuucuaccaggaggcggcccccagcauguccgaggucgcccucgugcgguacaucaaccccgacaccgggcgcgcccuguucgaggccaagcugcaccgggcgggcuucaugaccgugagcuccaacacgagcgcccccgucguggugccggccaacggguacuuccgcuucgacuccugggucaaccaguucuacagccucgcccccaugggcaccgggaacggccggcgccgcgugcaguga

SEQ ID NO: 10707 - RNA, 1629 nt, Artificial Sequence
  derived and/or modified sequence opt1 from capsid_protein__Norovirus__BAG68708
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgacuccaagaugcggaucgucgccaugcuguacacgccccugcgcagcaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguucccggucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacaucaccaucaccaaccugaacgggucccccuucgaccccagcgaggacaucccggcgccccucggcguccccgacuuccaggggcggguguucggcaucaucucccagcgcgacaagcagaacgcgacggggcacagcgagccggccaaccggggccacgacgccgugguccccaccuacaccgcccaguacacccccaagcugggccagauccagaucgggacguggcagaccgacgaccugaccgugaaccagcccgugaaguucaccccggucggccucaacgacacggagcacuucaaccaguggguggugccccgcuacgccggggcgcugaaccugaacaccaaccucgcccccagcgucgcccccguguucccgggcgagcggcugcuguucuuccgcuccuacaucccccucaagggcggguacggcaaccccgccaucgacugccugcugccccaggagugggugcagcacuucuaccaggaggcggccccgagcauguccgaggucgcccucgugcgguacaucaaccccgacaccgggcgcgcccuguucgaggccaagcugcaccgggcgggcuucaugaccgugagcuccaacacgagcgcccccgucguggcccccgccaacggguacuuccgcuucgacuccugggugaaccaguucuacagccucgccccgaugggcaccgggaacggccggcgccgcguccaguga

SEQ ID NO: 10708 - RNA, 1629 nt, Artificial Sequence
  derived and/or modified sequence opt1 from capsid_protein__Norovirus__BAG68709
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgucccggacuuccaggggcggguguucggcaucaucagccagcgcgacaagcagaacgcgacggggcacaacgagcccgccaaccggggccacgacgccgugguccccaccuacaccgcccaguacacccccaagcugggccagauccagaucgggacguggcagaccgacgaccugaccgugaaccagccggugaaguucacccccgucggccucaacgacacggagcacuucaaccaguggguggugccccgcuacgccggggcgcugaaccugaacaccaaccucgcccccuccgucgccccgguguuccccggcgagcggcugcuguucuuccgcagcuacaucccccucaagggcggguacggcaaccccgccaucgacugccugcugccgcaggagugggugcagcacuucuaccaggaggcggcccccagcauguccgaggucgcccucgugcgguacaucaaccccgacaccgggcgcgcccuguucgaggccaagcugcaccgggcgggcuucaugaccgugagcuccaacacgagcgcccccgucguggugccggccaacggguacuuccgcuucgacuccugggucaaccaguucuacagccucgcccccaugggcaccgggaacggccggcgccgcgugcaguga

SEQ ID NO: 10709 - RNA, 1629 nt, Artificial Sequence
  derived and/or modified sequence opt1 from capsid_protein__Norovirus__BAG68711
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaucgcguccgggcacaacgagcccgccaaccggggccacgacgccguggugcccacguacaccgcccaguacacccccaagcugggccagauccagaucgggaccuggcagacggacgaccugaccgucaaccagccggugaaguucacccccgugggccucaacgacaccgaccacuucaaccagugggucgugccccgcuacgccggggcgcugaaccugaacacgaaccucgcccccagcguggccccggucuuccccggcgagcggcugcuguucuuccgcagcuacaucccccucaagggcggguacggcaaccccgccaucgacugccugcugccgcaggagugggugcagcacuucuaccaggaguccgcgcccagcauguccgagguggcccucguccgguacaucaaccccgacaccgggcgcgcccuguucgaggccaagcugcaccgggccggcuucaugaccgugagcuccaacaccagcgcgcccguggucgugccggccaacggguacuuccgcuucgacuccugggugaaccaguucuacagccucgcccccaugggcacggggaacggccggcgccgcacccaguga

SEQ ID NO: 10710 - RNA, 1629 nt, Artificial Sequence
  derived and/or modified sequence opt1 from capsid_protein__Norovirus__BAG68712
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacgcguccgggcacaacgagcccgccaaccggggccacgacgccguggugcccacguacaccgcccaguacacccccaagcugggccagauccagaucgggaccuggcagacggacgaccugaccgucaaccagccggugaaguucacccccgugggccucaacgacaccgagcacuucaaccagugggucgugccccgcuacgccggggcgcugaaccugaacacgaaccucgcccccagcguggccccggucuuccccggcgagcggcugcuguucuuccgcagcuacaucccccucaagggcggguacggcaaccccgccaucgacugccugcugccgcaggagugggugcagcacuucuaccaggaggcggcccccuccaugagcgagguggcccucguccgguacaucaaccccgacaccgggcgcgcccuguucgaggccaagcugcaccgggcgggcuucaugaccguguccagcaacaccuccgcccccguggucgugccggccaacggguacuuccgcuucgacagcugggugaaccaguucuacucccucgcccccaugggcacggggaacggccggcgccgcguccaguga

SEQ ID NO: 10711 - RNA, 1629 nt, Artificial Sequence; identical to SEQ ID NO: 10710
  derived and/or modified sequence opt1 from capsid_protein__Norovirus__BAG68713

SEQ ID NO: 10712 - RNA, 1629 nt, Artificial Sequence
  derived and/or modified sequence opt1 from capsid_protein__Norovirus__BAG68714
augaagauggccagcaacgacgccgcgcccuccaccgacggcgccgccgggcuggugccggagagcuccaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucaaccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacgcgagcgggcacaacgagcccgccaaccggggccacgacgccguggugcccacguacaccgcccaguacacccccaagcugggccagguccagaucgggaccuggcagacggacgaccugaccgugaaccagccggugaaguucacccccgucggccucaacgacaccgagcacuucaaccaguggguggugccccgcuacgccggggcgcugaaccugaacacgaaccucgcccccagcgucgccccgguguuccccggcgagcggcugcuguucuuccgcuccuacaucccccucaagggcggguacggcaaccccgccaucgacugccugcugccgcaggagugggugcagcacuucuaccaggaggcggcccccagcauguccgaggucgcccucgugcgguacaucaaccccgacaccgggcgcgcccuguucgaggccaagcugcaccgggcgggcuucaugaccgugagcuccaacaccagcgcccccgucguggugccggccaacggguacuuccgcuucgacuccugggucaaccaguucuacagccucgcccccaugggcacggggaacggccggcgccgcgugcaguga

SEQ ID NO: 10713 - RNA, 1629 nt, Artificial Sequence
  derived and/or modified sequence opt1 from capsid_protein__Norovirus__BAG68715
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacucccccgggcacaacgagcccgcgaaccggggccacgacgccguggugcccacguacaccgcccaguacaccccgaagcugggccagauccagaucgggaccuggcagacggacgaccugaccgucaaccagcccgugaaguucacccccgugggccucaacgacaccgagcacuucaaccagugggucgugccccgcuacgccggggcccugaaccugaacacgaaccucgcgccgagcguggcccccgucuuccccggcgagcggcugcuguucuuccgcagcuacaucccccucaagggcggguacggcaacccggccaucgacugccugcugccccaggagugggugcagcacuucuaccaggaggccgcgcccuccaugagcgagguggcccucguccgguacaucaaccccgacaccgggcgcgcccuguucgaggccaagcugcaccgggccggcuucaugaccguguccagcaacaccuccgcgccgguggucgugcccgccaacggguacuuccgcuucgacagcugggugaaccaguucuacucccucgcccccaugggcacggggaacggccggcgccgcguccaguga

SEQ ID NO: 10714 - RNA, 1629 nt, Artificial Sequence; identical to SEQ ID NO: 9234
  derived and/or modified sequence opt1 from capsid_protein__Norovirus__BAG68716

SEQ ID NO: 10715 - RNA, 1647 nt, Artificial Sequence
  derived and/or modified sequence opt1 from capsid_protein__Norovirus__BAG68799
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacgcgaccacgcgggcccacgaggccaagaucgacaccgccagcgggcgcuucacccccaagcucggcucccuggagaucagcaccgaguccgacgacuucgaccagaacaagccgacgcgguucacccccgucggcaucgggguggaccacgaggaggacuuccagcaguggacccugcccgacuacgcgggccaguucacccacaacaugaaccucgcccccgccgucgccccgaacuuccccggggagcagcugcuguucuuccgcagccagcuccccuccagcggcgggcgguccaacggcauccuggacugccuggugccccaggagugggugcagcacuucuaccaggagagcgccccgucccagagccaggucgcgcucgugcgcuacaucaaccccgacacgggccgcgugcuguucgaggccaagcugcacaagcucggguucaugaccaucgccaagaacggcgacucccccaucaccgugcccccgaacggguacuuccgguucgagagcugggucaaccccuucuacacccuggcccccaugggcacggggaacggccgccggcgcauccaguga

SEQ ID NO: 10716 - RNA, 1647 nt, Artificial Sequence
  derived and/or modified sequence opt1 from capsid_protein__Norovirus__BAG68800
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaccuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucagccuccccauccugacgaucuccgagaugagcaacucccgguuccccgugccgaucgacagccugcacaccucccccaccgagaacaucgucgugcagugccagaacgggcgcgugacccucgacggcgagcugauggggacgacccagcugcuccccagccagaucugcgccuuccggggcguccugacccgcuccaccagccgggcgagcgaccaggccgacacggccacgccccgccuguucgacuacuacuggcacauccagcucgacaaccugaacggcaccccguacgaccccgccgaggacauccccgggccgcugggcacccccgacuuccgggggaagguguucggcguggccucccagcgcaaccccgacaccaccacccgggcgcacgaggccaagaucgacaccgccagcgggcgcuucacgcccaagcucggcucccuggagaucagcaccgaguccgacgacuucgaccagaacaagccgacccgguucacccccgucggcaucgggguggaccacgaggaggacuuccagcaguggacgcugcccaacuacgccggccaguucacccacaacaugaaccucgcgcccgccgucgccccgaacuuccccggggagcagguccuguucuuccgcagccagcugcccuccagcggcgggcgguccaacggcauccucgacugccuggugccccaggagugggugcagcacuucuaccaggagagcgccccgucccagagccagguggcccuggugcgcuacgucaaccccgacaccggccgcguccucuucgaggcgaagcugcacaagcugggguucaugaccaucgcccggaacggcgacucccccaucacggugcccccgaacggguacuuccgcuucgagagcugggugaaccccuucuacacccucgcccccaugggcaccgggaacggccggcgccggauccaguga

SEQ ID NO: 10717 - RNA, 1623 nt, Artificial Sequence; identical to SEQ ID NO: 9308
  derived and/or modified sequence opt1 from capsid_protein__Norovirus__BAG68801

SEQ ID NO: 10718 - RNA, 1623 nt, Artificial Sequence
  derived and/or modified sequence opt1 from capsid_protein__Norovirus__BAG68802
augaagauggccagcaacgacgccacccccuccgacggcagcaccgcgaaccuggugccggaggucaacaacgaggugauggcccucgagcccguggccggggccgccaucgcggcccccgucgccggccagcagaacgugaucgaccccuggauccgcaacaacuucgugcaggcccccgggggcgaguucacggucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgaccccacgaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccauccugaccgucgaggagaugaccaacucccgguuccccaucccccuggagaagcuguucacgggcccgagcuccgccuucguggugcagccccagaacgggcgcugcaccaccgacggcguccugcuggggaccacgcagcucagccccgugaacaucugcaccuuccggggcgacgucacccacaucgccaacacccagaacuacacgaugaaccuggccucccagaacuggaacaacuacgacccgaccgaggagauccccgcgccccugggcacccccgacuucguggggcgcauccagggcgugcucacccagacgacccgcggggacggcagcacccgggggcacaaggccaccgucuccacgggcagcgugcacuucaccccgaagcugggcagcgugcaguucuccaccgacaccagcaacgaccuggagacggggcagaacacccgguucacccccgucggcguggugcaggacgggggcaccacgcaccgcaacgagccccagcaguggguccuccccgacuacuccgggcgggacagccacaacgugcaccuggccccggccguggcccccaccuuccccggcgagcagcuccucuucuuccgcuccaccaugcccggcugcagcggguacccgaacaugaaccuggacugccugcucccccaggaguggguccagcacuucuaccaggaguccgcgcccgcccagagcgacguggcccugcugcgguucgugaaccccgacaccggccgcguccucuucgagugcaagcugcacaaguccggguacgugaccguggcccacacgggccagcacgaccuggucaucccgcccaacggguacuuccgguucgacagcugggugaaccaguucuacacccucgcgcccaugggcaacggcgccgggcgccgccgggcccuguga

SEQ ID NO: 10719 - RNA, 1623 nt, Artificial Sequence
  derived and/or modified sequence opt1 from capsid_protein__Norovirus__BAG68803
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaaggaggacgggagcacgcggggccacaaggccaccguguacaccggcuccgcccccuucaccccgaagcuggggagcgugcaguucagcacggacaccgagaacgacuucgagacccaccagaacaccaaguucacgcccgucggcgugauccaggacggguccaccacccaccgcaacgagccccagcagugggugcuccccagcuacuccggccggaacguccacaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10720 - RNA, 1623 nt, Artificial Sequence; identical to SEQ ID NO: 9292
  derived and/or modified sequence opt1 from capsid_protein__Norovirus__BAG68804

SEQ ID NO: 10721 - RNA, 1623 nt, Artificial Sequence
  derived and/or modified sequence opt1 from capsid_protein__Norovirus__BAG68805
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucguguucgccgccgugccgcccaacuucccgaccgagggccugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggggacgacguguucaccgucuccugccgcgugcugacccggccgagccccgacuucgacuucaucuuccucgugccgcccaccgucgagucccgcacgaagcccuucagcgugcccauccugaccguggaggagaugaccaacucccgguuccccaucccccuggagcgccucuucaccggcccgagcuccgccuucgucgugcagccccagaacggccggugcacgaccgacgggguccugcugggcaccacccagcucagccccgugaacaucugcacguuccgcggggacgugacccacaucgccggcacccaggaguacaccaugaaccuggccucccagaacuggaacaacuacgacccgacggaggagguccccgcgccccugggcacccccgacuucauggggaagauccagggcgugcucacccagaccacgcggcgcgacgggagcacccggggccacaaggccaccgugagcaccggguccguccacuucacgccgaagcugggccgcauccaguucagcaccgacaccuccaacgacuucgagaccggccagaacacgcgguucacccccgugggggugguccaggacggcagcaccacccaccagaacgagccccagcagugggugcugcccaacuacuccgggcgcgacagccacaacgugcaccucgccccggccgucgcccccuccuuccccggcgagcagcugcuguucuuccggagcacgaugcccgggugcuccggcuacccgaacaugaaccucgacugccugcugccccaggagugggugcagcacuucuaccaggaggccgcgcccgcccagagcgacguggcccuccugcgcuucgucucccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcgcccaugggcaacgggacgggccgccggcgcgcccucuga

SEQ ID NO: 10722 - RNA, 1623 nt, Artificial Sequence
  derived and/or modified sequence opt1 from capsid_protein__Norovirus__BAG68806
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaacgcgggcgacgacguguucaccgucuccugccgcgugcugacccggcccagcccggacuucgacuucaucuuccucgugccgcccaccgucgagucccgcacgaagcccuucagcgugcccauccugaccguggaggagaugaccaacucccgguuccccaucccccuggagaagcuguucaccggccccagcuccgccuucaucguccagccgcagaacgggcgcugcacgaccgacggcgugcugcuggggaccacccagcucagccccgucaacaucugcacguuccggggcgacgugacccacaucgccggcacccaggaguacaccaugaaccuggccucccagaacuggaacaacuacgaccccacggaggagaucccggcgccccuggggacccccgacuucgugggcaagauccaggggguccucacccagaccacgcgccgggacggcagcacccgcgggcacaaggccaccgugagcaccggcuccgugcacuucacgcccaagcugggccggauccaguucagcaccgacaccuccaacgacuucgagaccgggcagaacacgcgcuucaccccggucggcguggugcaggacgggagcaccacccaccagaacgagccccagcaguggguccugcccaacuaccucggccgggacucccacaacgugcaccuggcccccgccguggccccgagcuuccccggggagcagcuccucuucuuccgcuccacgaugcccggcugcagcggcuaccccaacaugaaccuggacugccugcucccgcaggaguggguccagcacuucuaccaggaggccgcgcccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcgcccauggggaacggcacgggccgccgccgggcccuguga

SEQ ID NO: 10723 - RNA, 1647 nt, Artificial Sequence
  derived and/or modified sequence opt1 from capsid_protein__Norovirus__BAG68807
augaagauggccagcuccgacgccacccccagcaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucuccgccgcgcagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucacgguguccugccgggugcugacccgccccagccccgacuucuccuucaacuuccuggugcccccgaccguggagagcaagaccaagcccuucacgcuccccauccugaccaucuccgagaugagcaacucccgguuccccgugccgaucgacagccugcacaccucccccaccgagaacaucgucgugcagugccagaacgggcgcgugacgcucgacggcgagcugauggggaccacccagcugcuccccagccagaucugcgccuuccggggcguccugacccgcuccacgagccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacagcaccacccgggcccacgaggcgaaggucgacaccacggccgggcgcuucacccccaagcucggcucccuggagaucagcaccgaguccgacgacuucgaccagaaccagccgacccgguucacgcccgugggcaucggggucgaccacgaggccgacuuccagcaguggagccugcccgacuacuccggccaguucacccacaacaugaaccucgcccccgcgguggccccgaacuuccccggggagcagcugcuguucuuccgcagccagcuccccuccagcggcgggcgguccaacggcauccuggacugccuggugccccaggaguggguccagcacuucuaccaggagagcgccccggcccagacccagguggcccucgugcgcuacgucaaccccgacaccggccgcgugcuguucgaggcgaagcugcacaagcucggguucaugacgaucgccaagaacggcgacucccccaucaccgugcccccgaacggguacuuccgguucgagagcugggucaaccccuucuacacccuggcccccaugggcaccgggaacggccgccggcgcauccaguga

SEQ ID NO: 10724 - RNA, 1623 nt, Artificial Sequence
  derived and/or modified sequence opt1 from capsid_protein__Norovirus__BAG68808
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccgacuccugccgcgugcugacccggccgagccccgacuucgacuucaucuuccucgucccgcccaccguggagucccgcaccaagcccuucagcgugcccauccugaccgucgaggagaugaccaacucccgguuccccaucccccuggagaagcuguucacgggcccgagcuccgccuucguggugcagccccagaacgggcgcugcaccaccgacggcguccugcuggggaccacgcagcucagccccgugaacaucugcaccuuccggggcgacgucacccacaucgccggcacccagaacuacacgaugaaccuggccucccagaacuggaacaacuacgacccgaccgaggagauccccgcgccccuggggacccccgacuucgugggcaagauccagggggugcucacccagacgacccgccgggacggcagcacccgcgggcacaaggccaccgucuccacgggcagcgugcacuucaccccgaagcugggcagcgugcaguucuccaccgacaccagcaacgaccuggagacggggcagaacacccgguucacccccgucggcguggugcaggacggguccaccacgcaccagaacgagccccagcaguggguccuccccgacuacagcggccgcgacucccacaacgugcaccuggccccggccguggcccccaccuuccccggggagcagcuccucuucuuccggagcaccaugcccggcugcuccggcuacccgaacaugaaccuggacugccugcucccccaggaguggguccagcacuucuaccaggagagcgcccccgcgcaguccgacguggcccugcugcgcuucgugaaccccgacaccgggcggguccucuucgagugcaagcugcacaagagcggcuacgugaccguggcccacacggggcagcacgaccuggucaucccgcccaacggcuacuuccgcuucgacuccugggugaaccaguucuacacccucgcccccauggggaacggcgcgggccggcgccgcgcccuguga

SEQ ID NO: 10725 - RNA, 1623 nt, Artificial Sequence
  derived and/or modified sequence opt1 from capsid_protein__Norovirus__BAG68809
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccgacuccugccgcgugcugacccggccgagccccgacuucgacuucaucuuccucgucccgcccaccguggagucccgcaccaagcccuucagcgugcccauccugaccgucgaggagaugaccaacucccgguuccccaucccccuggagaagcuguucacgggcccgagcuccgccuucguggugcagccccagaacgggcgcugcaccaccgacggcguccugcuggggaccacgcagcucagccccgugaacaucugcaccuuccggggcgacgucacccacaucgccggcacccagaacuacacgaugaaccuggccucccagaacuggaacaacuacgacccgaccgaggagauccccgcgccccuggggacccccgacuucgugggcaagauccagggggugcucacccagacgacccgcggcgacgggagcacccggggccacaaggccaccgucuccacgggcagcgugcacuucaccccgaagcuggggagcgugcaguucuccaccgacaccagcaacgaccuggagacgggccagaacacccgcuucacccccgucgggguggugcaggacggcuccaccacgcaccagaacgagccccagcaguggguccuccccaacuacagcgggcgggacucccacaacgugcaccuggccccggccguggcccccaccuuccccggcgagcagcuccucuucuuccgcagcaccaugcccggcugcuccggguacccgaacaugaaccuggacugccugcucccccaggaguggguccagcacuucuaccaggagagcgcccccgcgcaguccgacguggcccugcugcgguucgugaaccccgacaccggccgcguccucuucgagugcaagcugcacaagagcggguacgugaccguggcccacacgggccagcacgaccuggucaucccgcccaacggguacuuccgguucgacuccugggugaaccaguucuacacccucgcccccaugggcaacggcgcggggcgccggcgcgcccuguga

SEQ ID NO: 10726 - RNA, 1623 nt, Artificial Sequence
  derived and/or modified sequence opt1 from capsid_protein__Norovirus__BAG68810
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccaacuacuccgggcgggacggccacaacgugcaccucgccccggccguggcccccagcuuccccggggagcagcugcuguucuuccgcuccacgaugcccggcugcagcggcuacccgaacaugaaccucgacugccugcugccccaggaguggguccagcacuucuaccaggaggccgcgcccgcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgggcccucuga

SEQ ID NO: 10727 - RNA, 1623 nt, Artificial Sequence
  derived and/or modified sequence opt1 from capsid_protein__Norovirus__BAG68811
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccaacacccaggaguacaccaugaaccuggccucccagaacuggaacaacuacgacccgacggaggagauccccgcgccccugggcacccccgacuucgugggcaagauccaggggguccucacccagaccacgcggcgggacggcagcacccgcgggcacaaggccaccgugagcaccggcuccgugcacuucacgccgaagcuggggcggauccaguucagcaccgacaccuccaacgacuucgagaccggccagaacacgcgcuucacccccgucggcguggugcaggacgggagcaccacccaccagaacgagccccagcaguggguccugcccaacuacuccggcggggacggccacaacgugcaccucgccccggccguggcccccagcuuccccggggagcagcugcuguucuuccgguccacgaugcccggcugcagcggcuacccgaacaugaaccucgacugccugcugccccaggaguggguccagcacuucuaccaggaggccgcgcccgcccaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcgcccauggggaacggcacgggccggcgccgcgcccucuga

SEQ ID NO: 10728 - RNA, 1623 nt, Artificial Sequence; identical to SEQ ID NO: 9855
  derived and/or modified sequence opt1 from capsid_protein__Norovirus__BAG68812

SEQ ID NO: 10729 - RNA, 1623 nt, Artificial Sequence
  derived and/or modified sequence opt1 from capsid_protein__Norovirus__BAG68813
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacagcuacgccggcggguucgaggugcaggucauccucgccggcaacgccuucacggccgggaagaucaucuucgcggccgugccgcccaacuucccgaucgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgccggggacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccacccccguggagaagcuguucaccggcccguccagcgcguucaucguccagccccagaacggccgcugcacgaucgacggggugcuccugggcaccacccagcugucccccgucaacaucugcaccuuccgcggggacgugacgcacaucgccggcacccaggaguacaccaugaaccucgccagccagaacuggaacaacuacgacccgaccgaggagauccccgcgccccugggcacgcccgacuucguggggaagauccagggcguccugacccagaccacccggcgggacgggagcacgcgcggccacaaggccaccguguccaccgggagcgugcacuucaccccgaagcucggccggauccaguucuccacggacaccagcaacgacuucgagacccgccagaacacccgguucacgcccgucggcgugauccaggacggguccaccacccaccagaacgagccccagcagugggugcugcccaacuacagcggccgcgacucccacaacguccaccuggccccggccguggcccccagcuuccccggggagcagcuccuguucuuccgguccaccaugcccggcugcagcggguacccgaacaugaaccuggacugccuccugccccaggagugggugcagcacuucuaccaggaggccgcccccgcgcaguccgacgucgcccugcuccgcuucgugaaccccgacacgggccgggugauguucgagugcaagcugcacaagagcggcuacaucaccgucgcccacaccgggcagcacgaccuggugaucccgcccaacggcuacuuccgcuucgacgccugggugaaccaguucuacacccucgcgcccauggggaacggcaccgggcgccggcgcgcccuguga

SEQ ID NO: 10730 - RNA, 1647 nt, Artificial Sequence
  derived and/or modified sequence opt1 from capsid_protein__Norovirus__BAG68814
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacaccacgacccgggcgcacgaggccaagaucgacaccaccagcgggcgcuucacgcccaagcucggcucccuggagaucagcaccgaguccgacgacuucgaccagaacaagccgacccgguucacccccgucggcaucgggguggaccgcgaggucgacuuccagcagugggcccugcccgacuacgccggccaguucacgcacaacaugaaccucgcgcccgccguggccccgaacuuccccggggagcagcugcuguucuuccggagccagcuccccuccagcggcgggcgcuccaacggcauccuggacugccuggugccccaggaguggguccagcacuucuaccaggagagcgccccgucccagagccagguggcccucgugcgcuacaucaaccccgacaccggccggguccuguucgaggcgaagcugcacaagcucggguucaugaccaucgccaagaacggcgacucccccaucaccgugcccccgaacggguacuuccgcuucgagagcugggugaaccccuucuacacgcuggcccccaugggcaccgggaacggccggcgccggauccaguga

SEQ ID NO: 10731 - RNA, 1647 nt, Artificial Sequence
  derived and/or modified sequence opt1 from capsid_protein__Norovirus__BAG68815
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacaccacgacccgggcgcacgaggccaagaucgacaccaccagcgggcgcuucacgcccaagcucggcucccuggagaucagcaccgaguccgacgacuucgaccagaacaagccgacccgguucacccccgucggcaucgggguggaccacgaggucgacuuccagcagugggcccugcccgacuacgccggccaguucacgcacaacaugaaccucgcgcccgccguggccccgaacuuccccggggagcagcugcuguucuuccgcagccagcuccccuccagcggcgggcgguccaacggcauccuggacugccuggugccccaggaguggguccagcacuucuaccaggagagcgccccgucccagagccagguggcccucgugcgcuacaucaaccccgacaccggccgcguccuguucgaggcgaagcugcacaagcucggguucaugaccaucgccaagaacggcgacucccccaucaccgugcccccgaacggguacuuccgguucgagagcugggugaaccccuucuacacgcuggcccccaugggcaccgggaacggccgccggcgcauccaguga

SEQ ID NO: 10732 - RNA, 1623 nt, Artificial Sequence
  derived and/or modified sequence opt1 from capsid_protein__Norovirus__BAG68816
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaugaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcgcggcgacggguccacccggggccacaaggccaccgugagcaccggcagcgugcacuucacgccgaagcuggggcgcauccaguucuccaccgacaccagcaacgacuucgagaccggccagaacacgcgguucacccccgucgggguggugcaggacggcuccaccacccaccagaacgagccccagcaguggguccugcccaacuacagcgggcgcgacucccacaacgugcaccucgccccggccguggcccccagcuuccccggcgagcagcugcuguucuuccgguccacgaugcccggcugcagcggguacccgaacaugaaccucgacugccugcugccccaggaguggguccagcacuucuaccaggaggccgcgcccgcccaguccgacguggcccuccugcgcuucgugaaccccgacaccggccggguccuguucgagugcaagcuccacaagagcggguacgugaccguggcccacaccggccagcacgaccuggucaucccgcccaacggguacuuccgcuucgacuccugggugaaccaguucuacacccuggcgcccaugggcaacggcacggggcggcgccgcgcccucuga

SEQ ID NO: 10733 - RNA, 1626 nt, Artificial Sequence
  derived and/or modified sequence opt1 from capsid_protein__Norovirus__BAH04374
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccgaucuacggccugcucgucgaccccagccugcccuccaacccccaguggcagaacgggcgcgugcacguggacggcacccugcucggcaccaccccggucagcggguccugggugagcugcuucgcggccgaggccgccuacgaguuccaguccggcaccggggaggucgccacguucacccugaucgagcaggacggcagcgcguacgugcccggggaccgggccgcgccccugggcuacccggacuucuccggccagcucgagaucgaggugcagaccgagaccacgaagaagggggagaagcugaaggucaccaccuucgagaugauccugggccccaccacgaacguggaccaggugcccuaccaggggcgcgucuacgccagccucaccgccgccgccagccuggaccugguggacggccgggugcgcgccgucccccgguccguguacggguuccaggacguggucccggaguacaacgacggccuccuggugccccuggccccgcccaucggccccuuccuccccggggaggugcugcugcgcuuccggaccuacaugcgccagaucgacagcaccgacgcggccgccgaggccaucgacugcgcccucccccaggaguucgucuccugguucgcgagcaacgccuucacggugcaguccgaggcccugcugcuccgguaccgcaacacccugaccggccagcugcuguucgagugcaagcucuacagcgagggguacaucgcccuguccuacagcggcuccgggccccugaccuucccgacggacggcuucuucgagguggucagcugggugccccgccucuaccagcuggccuccgugggcagccuggcgaccgggcggacccucaagcaguga

SEQ ID NO: 10734 - RNA, 1626 nt, Artificial Sequence
  derived and/or modified sequence opt1 from capsid_protein__Norovirus__BAH04377
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccgaucuacggccugcucgucgaccccagccugcccuccaacccccaguggcagaacgggcgcgugcacguggacggcacccugcucggcaccaccccggucagcggguccugggugagcugcuucgcggccgaggccgccuacgaguuccaguccggcaucggggaggucgccaccuucacgcugaucgagcaggacggcagcgcguacgugcccggggaccgggccgcgccccugggcuacccggacuucuccggccagcucgagaucgaggugcagaccgagaccaccaagaagggggagaagcugaaggucacgaccuucgagaugauccugggccccaccaccaacguggaccaggugcccuaccaggggcgcgucuacgccagccucacggccgccgccagccuggaccugguggacggccgggugcgcgccgucccccgguccguguacggguuccaggacguggucccggaguacaacgacggccuccuggugccccuggccccgcccaucggccccuuccuccccggggaggugcugcugcgcuuccggaccuacaugcgccagaucgacagcaccgacgcggccgccgaggccaucgacugcgcccucccccaggaguucgucuccugguucgcgagcaacgccuucaccgugcaguccgaggcccugcugcuccgguaccgcaacacgcugaccggccagcugcuguucgagugcaagcucuacagcgagggguacaucgcccuguccuacagcggcuccgggccccugaccuucccgaccgacggcuucuucgagguggucagcugggugccccgccucuaccagcuggccuccgugggcagccuggcgacggggcggacccucaagcaguga

SEQ ID NO: 10735 - RNA, 1623 nt, Artificial Sequence; identical to SEQ ID NO: 9995
  derived and/or modified sequence opt1 from capsid_protein__Norovirus__BAH29786

SEQ ID NO: 10736 - RNA, 1623 nt, Artificial Sequence
  derived and/or modified sequence opt1 from capsid_protein__Norovirus__BAH30707
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucuccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgggcccucuga

SEQ ID NO: 10737 - RNA, 1653 nt, Artificial Sequence
  derived and/or modified sequence opt1 from capsid_protein__Norovirus__BAL40869
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccaggugguccuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcgguggacuccaccgacagcccgcagcgggcccgcgaccacccccuccacguccaggugaagaaccuggacgggacccaguacgaccccacggacgacaucccggccgugcugggcgccaucgacuucaagggcaccgucuucgggguggccucccagcgggacgugagcggcacccaggagcaggggcacuacgcgacccgcgcccacgaggcccacaucgacacgaccgaccccaaguacgcccccaagcucggcaccauccugaucaaguccgagagccccgacuucaacaccaaccagccgauccgguucacgcccgucgggaugggcgacaacaacuggcgccagugggagcugcccgacuacagcggccggcucacccugaacaugaaccuggcgcccgccguguccccgagcuuccccggggagcgcauccucuucuuccgcuccaucgugcccagcgccggcggguacggcuccggguacaucgacugccugaucccccaggaguggguccagcacuucuaccaggaggccgccccgagccaguccgcgguggcccuggugcgguacgucaaccccgacaccggccgcaacaucuucgaggccaagcuccaccgggagggcuuccugaccguggccaacagcgggaacaaccccaucguggugcccccgaacggcuacuuccgcuucgaggccugggugaaccaguucuacacgcuggcgcccaugggguccggccaggggcggcgccgggcccaguga

SEQ ID NO: 10738 - RNA, 1644 nt, Artificial Sequence
  derived and/or modified sequence opt1 from capsid_protein__Norovirus__BAL40870
augaagauggccagcuccgacgccgcccccagcaacgacggcgccgccaaccuggugccggaggccaacaacgaggucauggcccucgagcccguggugggggcguccaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucagccaccugucccgcauguacaacggcuacgcgggcgggaugcagguccagguggugcuggccggcaacgccuucaccgccgggaagaucaucuucgccgcggugccgccccacuuccccguggagaacaucagcgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagaccaagcccuucacgcuccccauccugacccugggggagcucagcaacucccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccagccgcuccagcgacuccaccgacagcgcgccccggcgccgggaccacccccuccacgugcagcugaagaaccuggacggcacccaguacgacccgacggacgagguccccgccgugcucggggccaucgacuucaagggcaccguguucggggucgccucccagcgcgacgugagcggccagcaggucggggccacccgggcccacgaggugcacaucaacaccacggacccccgcuacacccccaagcugggcagcauccugaugcacuccgagagcgacgacuucgugaccggccagccggugcgguucacccccaucgggaugggcgacaacgacuggcaccagugggagcuccccgacuacuccgggcaccugacgcugaacaugaaccucgcccccgcggucgccccggccuuccccggcgagcgcauccuguucuuccgcagcaucgugcccuccgccgggggcuacggcagcgggcagaucgacugccugaucccccaggagugggugcagcacuucuaccaggaggcggccccgucccagagcgccgucgcccucauccgguacgugaaccccgacaccggccgcaacaucuucgaggccaagcugcaccgggagggguucaucaccguggcgaacuccggcaacaaccccaucgucgcgcccccgaacggguacuuccgcuucgaggccugggugaaccaguucuacacccugacgcccaugggcaccggccaggggcggcgccggaaccaguga

SEQ ID NO: 10739 - RNA, 1644 nt, Artificial Sequence
  derived and/or modified sequence opt1 from capsid_protein__Norovirus__BAL40871
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgacgacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucaacaccacggacccccgcuacacccccaagcugggcagcauccugaugcacagcgaguccgacgacuucgugaccggccagccggugcgguucacccccaucgggaugggcgacaacgacuggcaccagugggagcuccccgacuacagcgggcaccugacgcugaacaugaaccucgcccccgcggucgccccggccuuccccggcgagcgcauccuguucuuccgcuccauggugcccagcgccgggggcuacggcuccgggcagaucgacugccugaucccccaggagugggugcagcacuucuaccaggaggcggccccgagccaguccgccgucgcccucauccgguacgugaaccccgacaccggccgcaacaucuucgaggccaagcugcaccgggagggguucaucaccguggcgaacagcggcaacaaccccaucgucgugcccccgaacggguacuuccgcuucgaggccugggugaaccaguucuacacccugacgcccaugggcaccggccaggggcggcgccggaaccaguga

SEQ ID NO: 10740 - RNA, 1644 nt, Artificial Sequence
  derived and/or modified sequence opt1 from capsid_protein__Norovirus__BAL40872
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgcgaucgacuucaagggcaccgucuucgggguggccucccagcggaacaccacgggcaacagcgugggggccacccgcgcccacgagguccacaucgacaccaccaacccccgguacacgccgaagcugggcagcgugcugaugaacuccgagagcuccgacuucgacgacgggcagccgaccugcuucacccccaucggcaugggcgccgacgacuggcaccagugggagcuccccgaguacagcgggcaccugacccugaacaugaaccucgcgcccgccguggcccccgccuuccccggcgagcgcauccuguucuuccgguccgucgugcccagcgccgggggcuacggguccggccagaucgacugccugaucccgcaggagugggugcagcacuucuaccaggaggccgcccccagccaguccgccgucgcccucauccgcuacgugaaccccgacacgggccgcaacaucuucgaggcgaagcugcaccgggagggguucaucaccguggccaacagcggcaacaaccccaucgucgugccgcccaacggguacuuccgcuucgaggccugggugaaccaguucuacacccugacccccaugggcacggggcagggccggcgccggguccaguga

SEQ ID NO: 10741 - RNA, 1644 nt, Artificial Sequence
  derived and/or modified sequence opt1 from capsid_protein__Norovirus__BAL40873
augaagauggccagcaacgacgccgcgcccuccaacgacggcgccgccaaccuggugccggaggccaacaacgaggucauggcccucgagcccguggcgggggccagcaucgccgcccccguggucggccagcagaacaucaucgaccccuggauccgcgagaacuucgugcaggcgccgcagggggaguucaccgugagcccccggaacucccccggcgagaugcugcugaaccucgagcuggggcccgagcugaacccguaccucucccaccugagccgcauguacaacggcuacgccggcgggaugcagguccagguggugcuggccggcaacgccuucaccgccgggaagaucaucuucgcggccgucccgccccacuuccccguggagaacaucuccgccgcccagaucacgaugugcccccacgugaucgucgacgugcggcagcucgagcccgugcugcugccccuccccgacauccgcaaccgguucuuccacuacaaccaggaggacaccccgcgcaugcggcuggucgccaugcuguacacgccccuccgcgcgaacagcggcgaggacguguucaccguguccugccggguccugacccgccccgcccccgacuucgaguucaccuuccuggugccgcccaccguggagagcaagaccaagcccuucacgcuccccauccugacccugggggagcucuccaacagccgguucccggcccccaucgacaugcuguacaccgaccccaacgagaccaucgucgugcagccccagaacggccgcugcacgcuggacggcacccuccaggggaccacccagcuggugccgacgcagaucugcuccuuccggggcacccugaucagccagaccucccgcagcgccgacuccaccgacagcgcgccccggguccgcaaccacccccuccacgugcagcugaagaaccuggacgggacgccguacgaccccaccgacgagguccccgccgugcucggcgccaucgacuucaagggcaccguguucggggucgccucccagcggaacaccacgggcaacagcgugggggccacccgcgcccacgaggugcacaucgacaccaccaacccccgguacacgccgaagcugggcagcguccugaugcacuccgagagcuccgacuucgacgacgggcagcccaucagcuucacccccaucggcaugggcgcggacgacuggcaccagugggagcuccccgaguacuccgggcaccugacccugaacaugaaccucgccccggccguggcccccgcguuccccggcgagcgcauccuguucuuccggagcgugguccccuccgccgggggcuacgggagcggccagaucgacugccugaucccgcaggagugggugcagcacuucuaccaggaggccgcccccucccagagcgccguggcgcucguccgcuacgugaaccccgacaccggccgcaacaucuucgaggccaagcugcaccgggagggguuccugacgguggccaacuccggcaacaaccccaucgucgugccgcccaacggguacuuccgcuucgaggccugggugaaccaguucuacacccucacccccaugggcaccgggcagggccggcgccggguccaguga

SEQ ID NO: 10742 - RNA, 1626 nt, Artificial Sequence
  derived and/or modified sequence opt1 from capsid_protein__Norovirus__BAL60900
augcgcaugagcgacggcgccgcccccaaggcgaacggguccgaggccagcggccaggaccuggugcucaccgccgucgagcaggccgugccgauccagcccguggccggggcggcccuggccgcccccgcggccggccagaucaaccagaucgaccccuggaucuuccagaacuucguccagugcccgcugggggaguucuccaucagcccccggaacacccccggcgagauccucuucgaccuggcccugggccccgggcucaacccguaccuggcccaccuguccgccauguacacgggcuggguggggaacauggaggugcagcucguccuggcgggcaacgccuucaccgccgggaaggugguggucgcccuggugccgcccuacuuccccaagggcagccucaccaccgcccagaucacgugcuucccccacgugaugugcgacguccgcacccuggagcccauccagcugccccuccuggacgugcggcgcgugcuguggcacgcgacccaggaccaggaggaguccaugcggcucgucugcaugcuguacacgccccugcgcaccaacagcccgggcgacgaguccuucguggugagcgggcggcuccuguccaagcccgccgccgacuucaacuucgucuaccugaccccgcccaucgagcgcaccaucuaccggaugguggaccuccccgugcugcagccccgccugugcacccacgcccgguggcccgcccccgucuacggccuccugguggacccgagccugcccuccaacccccaguggcagaacgggcgcgugcacgucgacggcacgcuccugggcaccacccccgugagcggguccugggucagcugcuucgcggccgaggccgccuacgaguuccaguccggcaccggggagguggccacguucacccugaucgagcaggacggcagcgcguacgugccgggggagcgggccgcgccccucggcuaccccgacuucuccggccagcuggagaucgagguccagaccgagaccacgaagcgcggggagaagcugaaggugaccaccuucgagaugauccucggcccgaccacgaacguggaccaggcccccuaccaggggcgggucuacgccagccugagcgccgccgccucccuggaccucguggacggccgcgugcgggccgucccccgcagcaucuacggguuccaggacgugauccccgaguacaacgacggccugcuggugccgcucgcgccgcccaucggccccuuccugcccggggagguccugcuccgguuccgcaccuacaugcgccagguggacuccagcgacgccgccgccgaggccaucgacugcgcgcugccccaggaguucguguccugguucgccagcaacggcuucaccguccaguccgaggcccugcuccugcgguaccgcaacacccugacggggcagcuccuguucgagugcaagcuguacagcgagggcuacaucgcccuguccuacagcggguccggcccccucaccuuccccaccgacggcuucuucgagguggugagcugggucccgcggcuguaccagcuggccuccguggggagccucgugaccggccgcacgcugaagcaguga

SEQ ID NO: 10743 - RNA, 1623 nt, Artificial Sequence
  derived and/or modified sequence opt1 from capsid_protein__Norovirus__BAQ55211
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcaccagcacguaccgcaugaaccuggccucccagaacuggaacaacuacgacccgaccgaggagauccccgcgccccuggggacccccgacuucgugggcaagauccaggggaugcucacccagacgaccaagggcgacgggagcacccggggccacaaggccaccgucagcacgggcuccguggacuucaccccgaagcuggggagcgugcaguucgccaccgacaccgacaacgacuucgagacgggccagaacacccgcuucacccccgucggggugauccaggacggcuccggggcccaccggaacgagccccagcagugggugcugcccaacuacagcggccgcaccguccacaacgugcaccucgccccggccguggcccccacguuccccggcgagcagcugcuguucuuccgguccaccaugcccgggugcagcggcuacccgaacauggaccucgacugccugcugccccaggaguggguccagcacuucuaccaggaggcggcccccgcccaguccgacguggcccuccugcgcuucgugaaccccgacaccgggcggguccuguucgagugcaagcuccacaagaccggcuacgugaccguggcgcacacggggcagcacgaccuggucaucccgcccaacggcuacuuccgcuucgacagcugggugaaccaguucuacacccuggcccccaugggcaacggggccggccggcgccgcgcccucuga

SEQ ID NO: 10744 - RNA, 1623 nt, Artificial Sequence; identical to SEQ ID NO: 9148
  derived and/or modified sequence opt1 from capsid_protein__Norovirus__BAQ55212

SEQ ID NO: 10745 - RNA, 1620 nt, Artificial Sequence
  derived and/or modified sequence opt1 from capsid_protein__Norovirus__BAQ55213
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacaucagcggcaccuccacguaccgcaugaaccuggccagccagaacuggaacaacuacgaccccaccgaggagaucccggcgccccuggggacccccgacuucgugggcaagauccaggggaugcucacccagacgaccaagggcgacgggagcacccggggccacaaggccaccgucuccacgggcagcguggacuucacccccaagcugggguccgugcaguucgacaccgacaccaacaacgaccuggagacgggccagaacacccgcuucaccccggucggggugauccaggacggcagcgcccaccggaacgagccccagcagugggugcuccccgacuacuccgggcgcaccguccacaacgugcaccuggcccccgccguggccccgacguuccccggcgagcagcuccucuucuuccggagcaccaugcccggcugcuccggguaccccaacauggaccuggacugccugcucccgcaggaguggguccagcacuucuaccaggaggccgcgcccgcccagagcgacguggcccugcugcgcuucgugaaccccgacaccggccggguccucuucgagugcaagcugcacaagaccggguacgugaccguggcccacacgggccagcacgaccuggucaucccgcccaacggguacuuccgcuucgacuccugggugaaccaguucuacacccucgcgcccaugggcaacggcgccgggcggcgccgcgcccuguga

SEQ ID NO: 10746 - RNA, 1623 nt, Artificial Sequence
  derived and/or modified sequence opt1 from capsid_protein__Norovirus__BAQ55214
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcaccuccacguaccgcaugaaccuggccagccagaacuggaacaacuacgaccccaccgaggagaucccggcgccccuggggacccccgacuucgugggcaagauccaggggaugcucacccagacgaccaagggcgacgggagcacccggggccacaaggccaccgucuccacgggcagcguggacuucacccccaagcugggguccgugcaguucgccaccgacaccgacaacgacuucgagacgggccagaacacccgcuucaccccggucggggugauccaggacggcagcggggcccaccggaacgagccccagcagugggugcugcccgacuacuccggcaagaccguccacaacgugcaccucgcccccgccguggccccgacguuccccggcgagcagcugcuguucuuccgcagcaccaugcccgggugcuccggcuaccccaacauggaccucgacugccugcugccgcaggaguggguccagcacuucuaccaggaggcggcccccgcccagagcgacguggcccuccugcgguucgugaaccccgacaccgggcgcguccuguucgagugcaagcuccacaagaccggcuacgugaccguggcgcacacggggcagcacgaccuggucaucccgcccaacggcuacuuccgguucgacuccugggugaaccaguucuacacccuggcccccaugggcaacggggccggccgccggcgcgcccucuga

SEQ ID NO: 10747 - RNA, 1620 nt, Artificial Sequence
  derived and/or modified sequence opt1 from capsid_protein__Norovirus__BAQ55215
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgacaccgacaccaacaacgaccuggagacgggccagaacacccgguucacccccgucggggugauccaggacggcagcgcccaccgcaacgagccccagcagugggugcuccccgacuacuccgggcggaccguccacaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggccgcgcccgcccagagcgacguggcccugcugcgguucgugaaccccgacaccggccgcguccucuucgagugcaagcugcacaagaccggguacgugaccguggcccacacgggccagcacgaccuggucaucccgcccaacggguacuuccgguucgacuccugggugaaccaguucuacacccucgcgcccaugggcaacggcgccgggcgccgccgggcccuguga

SEQ ID NO: 10748 - RNA, 1620 nt, Artificial Sequence
  derived and/or modified sequence opt1 from capsid_protein__Norovirus__BAQ55216
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccagaucaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcacgaagcccuucaccgugcccauccugaccgucgaggagaugaccaacagccgguuccccaucccccuggagaagcuguucacgggccccuccagcgccuucguggugcagccgcagaacgggcgcugcaccaccgacggcguccugcuggggaccacgcagcucucccccgugaacaucugcaccuuccggggcgacgucacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgugagcacgggcagcgucgacuucaccccgaagcugggguccgugcaguucgacaccgacaccaacaacgaccuggagacgggccagaacacccgguucacccccgugggggucauccaggacggcagcgcccaccgcaacgagccccagcagugggugcuccccgacuacuccgggcggaccgugcacaacguccaccuggccccggccguggcccccacguuccccggcgagcagcuccucuucuuccgcagcaccaugcccggcugcuccggguacccgaacauggaccuggacugccugcucccccaggagugggugcagcacuucuaccaggaggccgcgcccgcccagagcgacgucgcccugcugcgguucgugaaccccgacaccggccgcguccucuucgagugcaagcugcacaagaccggguacgugaccguggcccacacgggccagcacgaccuggugaucccgcccaacggguacuuccgguucgacuccugggucaaccaguucuacacccucgcgcccaugggcaacggcgccgggcgccgccgggcccuguga

SEQ ID NO: 10749 - RNA, 1620 nt, Artificial Sequence
  derived and/or modified sequence opt1 from capsid_protein__Norovirus__BAQ55217
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcacccacacguaccgcaugaaccuggccucccagaacuggaacaacuacgaccccaccgaggagaucccggcgccccuggggacccccgacuucgugggcaagauccaggggaugcucacccagacgaccaagggcgacgggagcacccggggccacaaggccaccgucagcacgggcuccguggacuucacccccaagcuggggagcgugcaguucgccaccgacaccaacaacgacuucgagacgggccagaacacccgcuucaccccggucggggugauccaggacggcuccgcccaccggaacgagccccagcagugggugcugcccgacuacagcgggaagaccguccacaacgugcaccucgcccccgccguggccccgacguuccccggcgagcagcugcuguucuuccgcuccaccaugcccggcugcagcggguaccccaacauggaccucgacugccugcugccgcaggaguggguccagcacuucuaccaggaggcggcccccgcccaguccgacguggcccuccugcgguucgugaaccccgacaccggccgcguccuguucgagugcaagcuccacaagaccggguacgugaccguggcgcacacgggccagcacgaccuggucaucccgcccaacggguacuuccgguucgacagcugggugaaccaguucuacacccuggcccccaugggcaacggcgccgggcgccggcgcgcccucuga

SEQ ID NO: 10750 - RNA, 1623 nt, Artificial Sequence
  derived and/or modified sequence opt1 from capsid_protein__Norovirus__BAQ55218
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccaacacccacacguaccgcaugaaccuggccagccagaacuggaacaacuacgacccgaccgaggagauccccgcgccccugggcacccccgacuucguggggaagauccagggcaugcucacccagacgaccaagggggacggcuccacccgggggcacaaggccaccgucagcacgggcagcguggacuucaccccgaagcugggcuccgugcaguucaccaccgacacggacaacgacuucgagaccgggcagaacacccgcuucacccccgucggcgugauccaggacgggaacggcgcccaccggaacgagccccagcagugggugcugcccgacuacagcgggggcacgguccacaacgugcaccucgccccggccguggcccccaccuuccccggcgagcagcugcuguucuuccgcuccaccaugcccgggugcagcggcuacccgaacauggaccucgacugccugcugccccaggaguggguccagcacuucuaccaggaggccgcgcccgcccaguccgacguggcccuccugcgguucgugaaccccgacaccgggcgcguccuguucgagugcaagcuccacaagaccggcuacgugacgguggcccacaccgggcagcacgaccuggucaucccgcccaacggcuacuuccgguucgacagcugggugaaccaguucuacacccuggcgcccaugggcaacggggccggccgccggcgcgcccucuga

SEQ ID NO: 10751 - RNA, 1623 nt, Artificial Sequence; identical to SEQ ID NO: 9361
  derived and/or modified sequence opt1 from capsid_protein__Norovirus__BAR47396

SEQ ID NO: 10752 - RNA, 1623 nt, Artificial Sequence; identical to SEQ ID NO: 9852
  derived and/or modified sequence opt1 from capsid_protein__Norovirus__BAR47397

SEQ ID NO: 10753 - RNA, 1623 nt, Artificial Sequence
  derived and/or modified sequence opt1 from capsid_protein__Norovirus__BAR47398
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgaccaggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcaccggccgccggcgcgcgcuguga

SEQ ID NO: 10754 - RNA, 1623 nt, Artificial Sequence; identical to SEQ ID NO: 9892
  derived and/or modified sequence opt1 from capsid_protein__Norovirus__BAR47400

SEQ ID NO: 10755 - RNA, 1623 nt, Artificial Sequence
  derived and/or modified sequence opt1 from capsid_protein__Norovirus__BAR47401
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccacccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcgacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcgcuucuccaccgacaccgagaacgacuucgagacccaccagaacacgaaguucacccccgucggcgugauccaggacgggagcaccacccaccggaacgagccccagcagugggugcuccccuccuacagcggccgcgacguccacaacgugcaccuggccccggccguggcgcccacguuccccggggagcagcuccucuucuuccgguccaccaugcccggcugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcacaagagcggcuacgugaccguggcccacaccgggcagcacgaccuggucaucccgcccaacggcuacuuccgcuucgacuccugggugaaccaguucuacacgcucgcccccauggggaacggcaccggccggcgccgcgcccuguga

SEQ ID NO: 10756 - RNA, 1623 nt, Artificial Sequence
  derived and/or modified sequence opt1 from capsid_protein__Norovirus__BAR47403
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccaucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcgggacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 10757 - RNA, 1623 nt, Artificial Sequence; identical to SEQ ID NO: 9441
  derived and/or modified sequence opt1 from capsid_protein__Norovirus__BAR47404

SEQ ID NO: 10758 - RNA, 1623 nt, Artificial Sequence
  derived and/or modified sequence opt1 from capsid_protein__Norovirus__BAR47405
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcacccccuucacgccgaagcugggguccgugcaguucagcaccgacaccgagaacgacuucgagacccaccagaacacgaaguucacccccgugggcgucauccaggacggguccaccacccaccgcaacgagccccagcagugggugcuccccagcuacuccggccggaacgugccgaacguccaccuggcccccgccguggcccccacguuccccggggagcagcuccucuucuuccgcagcaccaugccgggcugcuccggcuaccccaacauggaccuggacugccugcucccccaggagugggugcagcacuucuaccaggaggcggcccccgcccagagcgacgucgcccugcugcgguucgugaacccggacaccgggcgcguccucuucgagugcaagcugcacaaguccggcuacgugaccguggcgcacaccgggcagcacgaccuggugaucccgcccaacggcuacuuccgguucgacagcugggucaaccaguucuacacgcucgcccccauggggaacggcaccggccgccggcgcgcccuguga

SEQ ID NO: 10759 - RNA, 1623 nt, Artificial Sequence; identical to SEQ ID NO: 10051
  derived and/or modified sequence opt1 from capsid_protein__Norovirus__BAR47406

SEQ ID NO: 10760 - RNA, 1623 nt, Artificial Sequence
  derived and/or modified sequence opt1 from capsid_protein__Norovirus__BAR47407
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcuccuggggaccacccagcucucccccgucaacaucugcacguuccggggcgacgugacccacaucgccggcagcgggaacuacaccaugaaccuggccuccgugaacuggaacaacuacgaccccaccgaggagaucccggcgccccugggcacgcccgacuucgucgggaagauccagggcaugcucacccagaccaccaagggggacggcagcacgcgcggccacaaggccaccguguacaccgggagcgcccccuucaccccgaagcugggcuccgugcaguucagcacggacaccgagaacgacuucgagacccaccagaacaccaaguucacgcccgucggggugauccaggacggcaacaccacccaccggaacgagccccagcagugggugcugcccuccuacagcgggcgcaacgucccgaacgugcaccucgcccccgccguggcgcccaccuuccccggcgagcagcugcuguucuuccgguccacgaugccgggcugcagcggguaccccaacauggaccucgacugccugcugccccaggaguggguccagcacuucuaccaggaggccgcccccgcccaguccgacguggcgcuccugcgcuucgugaacccggacaccggccggguccuguucgagugcaagcuccacaagagcggguacgugaccguggcccacaccggccagcacgaccuggucaucccgcccaacggguacuuccgcuucgacuccugggugaaccaguucuacacccuggcccccaugggcaacggcacggggcggcgccgggcccucuga

SEQ ID NO: 10761 - RNA, 1623 nt, Artificial Sequence
  derived and/or modified sequence opt1 from capsid_protein__Norovirus__BAR47408
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggaucaagaacaacuucguccaggcccccgggggcgaguucaccgugagcccccgcaacgcgcccggggagauccugugguccgcgccccugggcccggaccucaaccccuaccugucccaccuggcccggauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcgccagcuggagcccgugcucaucccgcugcccgacguccggaacaacuucuaccacuacaaccagagcaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggaccaagcccuucacgguccccauccugaccguggaggagaugaccaacucccgcuuccccaucccccuggagaagcuguucaccggccccagcggggccuucgugguccagccgcagaacggccggugcacgaccgacggggugcugcugggcaccacccagcucucccccgucaacaucugcacguuccgcggcgacgugacccacaucgccgggagccggaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcgcggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccggaacgagccccagcagugggugcuccccuccuacagcgggcgcaacguccacaacgugcaccuggcccccgccguggccccgaccuuccccggcgagcagcuccucuucuuccgguccacgaugcccggcugcagcggguaccccaacauggaccuggacugccugcucccgcaggaguggguccagcacuucuaccaggaggccgcccccgcgcaguccgacguggcccugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgggcccuguga

SEQ ID NO: 10762 - RNA, 1623 nt, Artificial Sequence; identical to SEQ ID NO: 10177
  derived and/or modified sequence opt1 from capsid_protein__Norovirus__BAR47410

SEQ ID NO: 10763 - RNA, 1623 nt, Artificial Sequence
  derived and/or modified sequence opt1 from capsid_protein__Norovirus__BAR47412
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccggauccaguucgagacggacaccgaccacgacuucgaggccaaccagaacaccaaguucacccccgugggggucauccaggacggcgggacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgggucgccuga

SEQ ID NO: 10764 - RNA, 1623 nt, Artificial Sequence
  derived and/or modified sequence opt1 from capsid_protein__Norovirus__BAR47413
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccggauccaguucgagacggacaccgaccacgacuucgaggccaaccagaacaccaaguucacccccgugggggucauccaggacggcgggacgacccaccgcaacgagccccagcaguggaugcugcccuccuacagcggccggaacacccacaacgugcaccucgccccggcgguggcccccaccuuccccggggagcagcugcuguucuuccgcuccacgaugcccggcugcagcggcuacccgaacauggaccucgacugccugcugccccaggaguggguccaguacuucuaccaggaggccgcccccgcgcaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacgggccgccgccggguggccuga

SEQ ID NO: 10765 - RNA, 1623 nt, Artificial Sequence; identical to SEQ ID NO: 10764
  derived and/or modified sequence opt1 from capsid_protein__Norovirus__BAR47414

SEQ ID NO: 10766 - RNA, 1623 nt, Artificial Sequence; identical to SEQ ID NO: 10764
  derived and/or modified sequence opt1 from capsid_protein__Norovirus__BAR47415

SEQ ID NO: 10767 - RNA, 1623 nt, Artificial Sequence; identical to SEQ ID NO: 9691
  derived and/or modified sequence opt1 from capsid_protein__Norovirus__BAR47417

SEQ ID NO: 10768 - RNA, 1623 nt, Artificial Sequence
  derived and/or modified sequence opt1 from capsid_protein__Norovirus__BAR47418
augaagauggccagcuccgacgccaacccgcccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccccgcugggccccgaccucaaccccuaccugucccaccuggcccgcauguacaacggcuacgccgggggcuucgaggugcaggucauccucgccgggaacgcguucaccgccggcaaggugaucuucgccgccgugcccccgaacuuccccacggaggggcugagccccucccaggucaccauguucccccacaucgugguggacguccggcagcuggagccggugcucaucccccugcccgacgugcgcaacaacuucuaccacuacaaccagagcaacgaccccaccaucaagcugaucgccaugcucuacaccccgcugcgggcgaacaacgccggcgacgacgucuucacgguguccugccgcgugcugacccggcccagccccgacuucgacuucaucuuccucgugcccccgaccgucgagucccgcaccaagcccuucagcgugcccguccugacgguggaggagaugaccaacucccgguuccccaucccgcuggagaagcuguucaccggccccagcuccgccuucgucgugcagccccagaacgggcgcugcaccacggacggcgugcuccuggggaccacccagcucagcccggucaacaucugcaccuuccggggcgacgugacgcacaucaccggcucccacaacuacaccaugaaccuggccagccagaacuggaacaacuacgaccccaccgaggagauccccgcgccccuggggacgccggacuucgugggcaagauccaggggguccucacccagaccacccgcacggacggcuccacccgggggcacaaggccaccguguacaccggcagcgccgacuucgcccccaagcugggccgcgugcaguucgagacggacaccaaccacgacuucgaggccaaccagaacaccaaguucacccccgucggggugauccaggacggcgggacgacccaccggaacgagccccagcagugggugcugccgagcuacuccggccgcaacacccacaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcgccguguga

SEQ ID NO: 10769 - RNA, 1623 nt, Artificial Sequence
  derived and/or modified sequence opt1 from capsid_protein__Norovirus__BAR47421
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggccguguga

SEQ ID NO: 10770 - RNA, 1623 nt, Artificial Sequence; identical to SEQ ID NO: 9497
  derived and/or modified sequence opt1 from capsid_protein__Norovirus__BAR47422

SEQ ID NO: 10771 - RNA, 1623 nt, Artificial Sequence
  derived and/or modified sequence opt1 from capsid_protein__Norovirus__BAR47423
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgccaccgucgcccacaccgggcagcacgaccuggugaucccgcccaacggcuacuuccgcuucgacuccugggugaaccaguucuacacccuggcccccauggggaacggcacgggccgccggcgcgcgcucuga

SEQ ID NO: 10772 - RNA, 1623 nt, Artificial Sequence; identical to SEQ ID NO: 9499
  derived and/or modified sequence opt1 from capsid_protein__Norovirus__BAR47424

SEQ ID NO: 10773 - RNA, 1623 nt, Artificial Sequence; identical to SEQ ID NO: 9777
  derived and/or modified sequence opt1 from capsid_protein__Norovirus__BAR47426

SEQ ID NO: 10774 - RNA, 1623 nt, Artificial Sequence; identical to SEQ ID NO: 9441
  derived and/or modified sequence opt1 from capsid_protein__Norovirus__BAS53731

SEQ ID NO: 10775 - RNA, 1623 nt, Artificial Sequence
  derived and/or modified sequence opt1 from capsid_protein__Norovirus__BAS53732
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcgccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugaaccuggcgagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgccgacuucacccccaagcuggggagcgugcaguucggcaccgacacggagaacgacuucgagacccaccagaacaccaaguucaccccggucggggugauccaggacggcgggacgacccaccgcaacgagccccagcagugggugcuccccuccuacagcggccggaacguccacaacgugcaccuggcccccgccguggccccgaacuuccccggcgagcagcuccucuucuuccgcuccaccaugcccgggugcagcggcuaccccaacauggaccuggacugccugcucccgcaggaguggguccagcacuucuaccaggaggccgcccccgcgcaguccgacguggcccugcugcgguucgugaaccccgacaccgggcgcguccucuucgagugcaagcugcacaagagcggcuacgugacgguggcccacaccgggcagcacgaccuggucaucccgcccaacggcuacuuccgguucgacuccugggugaaccaguucuacacccucgcccccaugggcaacgggaccggccgccggcgcgcccuguga

SEQ ID NO: 10776 - RNA, 1623 nt, Artificial Sequence
  derived and/or modified sequence opt1 from capsid_protein__Norovirus__BAS53733
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugaaccuggccagccuguccuggaacaacuacgaccccaccgaggagaucccggcgccccucgggacccccgacuucgugggcaagauccaggggguccugacgcagaccaccaagggcgacgggagcacccggggccacaaggccacgguguacaccggcagcgcccccuucaccccgaagcugggguccgugcaguucagcaccgacacggagaacgacuucgagacccaccagaacaccaaguucacccccgucggcgugauccaggacgggggcacgacccaccgcaacgagccccagcagugggugcuccccuccuacagcgggcggaacgucccgaacgugcaccuggcccccgccguggcgcccaccuuccccggcgagcagcuccucuucuuccgcuccaccaugccgggcugcagcggguaccccaacauggaccuggacugccugcucccccaggaguggguccagcacuucuaccaggaggccgcccccgcccaguccgacguggcgcugcugcgguucgugaacccggacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcgcccuguga

SEQ ID NO: 10777 - RNA, 1623 nt, Artificial Sequence
  derived and/or modified sequence opt1 from capsid_protein__Norovirus__BAS53734
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucggcacggacaccgagaacgacuucgagacccaccagaacaccaaguucacgccggucggggugauccaggacggcuccaccacccaccgcaacgagccccagcagugggugcuccccagcuacuccgggcggaacguccacaacgugcaccuggcccccgccguggcgccgaacuuccccggcgagcaguuccuguucuuccgcagcaccaugcccggcugcuccggguaccccaacauggaccucgacugccugcugccgcaggaguggguccagcacuucuaccaggaggccgcccccgcccagagcgacguggcgcuccugcgguucgugaaccccgacacgggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacggcaccgggcgccggcgcgcccucuga

SEQ ID NO: 10778 - RNA, 1623 nt, Artificial Sequence
  derived and/or modified sequence opt1 from capsid_protein__Norovirus__BAS53945
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugaccacccccagcccggacuucgacuucaucuuccucgugccgcccaccguggagucccggacgaagcccuucaccguccccauccugaccguggaggagaugaccaacagccgcuuccccaucccccuggagaagcuguucacgggccccuccagcgccuucgugguccagccgcagaacgggcggugcaccaccgacggcgugcugcuggggaccacgcagcucucccccgucaacaucugcaccuuccgcggcgacgugacccacaucgccggcagccggaacuacaccaugaaccuggccucccugaacuggaacaacuacgaccccacggaggagaucccggcgccccucgggacccccgacuucgugggcaagauccaggggaugcugacccagaccacgaagggcgacgggagcacccgcggccacaaggccaccgucuacaccggcagcgcccccuucacgccgaagcugggguccgugcaguucagcaccgacaccgagaacgacuucgagacccaccagaacacgaaguucacccccgugggcgucauccaggacgggaacaccacccaccggaacgagccccagcagugggugcuccccuccuacagcggccgcaacgugccgaacguccaccuggcccccgccguggcgcccacguuccccggggagcagcuccucuucuuccgguccaccaugccgggcugcagcggcuaccccaacauggaccuggacugccugcucccccaggagugggugcagcacuucuaccaggaggccgcccccgcccaguccgacgucgcgcugcugcgcuucgugaacccggacaccgggcggguccucuucgagugcaagcugcacaagagcggcuacgugaccguggcccacaccgggcagcacgaccuggugaucccgcccaacggcuacuuccgcuucgacuccugggucaaccaguucuacacgcucgcccccauggggaacggcaccggccggcgccgggcccuguga

SEQ ID NO: 10779 - RNA, 1632 nt, Artificial Sequence
  derived and/or modified sequence opt1 from capsid_protein__Norovirus__CAK22261
augaugauggccagcaaggacgccucccccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucgugugcugcgucccgcccggguuccagagccgcacccuguccaucgcgcaggccacgcuguucccccacaucaucgccgacgugcggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucgucguggccggccgggugcugacgugccccuccagcgacuucaacuuccuguuccucgucccgcccaccguggagcagaagacccgccccuucuccgugcccaacaucccccugcagcugcucagcaacucccggguccccaaccugauccagagcauggugcuguccccggaccaggcgcagaacgugcaguuccagaacggccgcugcaccacggacgggcagcuccugggcaccacccccgucagcgugucccagauccugaaguuccgggggaaggugagcgccggcucccgcgucaucaaccucaccgagcuggacgggagccccuuccuggccuucgaggcccccgccccgacgggcuuccccgaccucggcaccagcgacuggcacguggagaugucccugaacagcaacucccagagcuccgggaaccccauccugcuccgggacauccagccgaacagcuccgacuucgucccccaccugggcagcguggcggugaccaccgccaucgacgucgccggggacuacacgggcaccauccaguggaccucccagcccagcaacgugacccccgugccggacgucaacuucuggacgaucccccaguacggguccaaccuggccgaggccagccagcucgcgcccgugguguacccgcccggcuucggcgaggccaucgucuacuucaugucccccauccccgggcccaacaccgcccacaagccgaaccuggugcccugccugcucccccaggaguucgugacccacuucgucagcgagcaggcccccuccaugggcgaggcggcccuggugcacuacguggacccggacaccaaccgcaaccugggggaguucaagcucuaccccgagggcuucaucacgugcguccccaacgggaccggcccccagcagcugccgcugaacggcguguucguguucgccagcugggucucccgguucuaccagcucaagcccguggggaccgccagcuccgcccgcggccggcugggggugcgccgguga

SEQ ID NO: 10780 - RNA, 1671 nt, Artificial Sequence
  derived and/or modified sequence opt1 from capsid_protein__Norovirus__CAR95870
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggagggcgucagcgccucccaggccacccaguucccccacgugaucaucgacgugcggacccuggaccccguccgccucccccugccggacgugcggagcacguucuuccacuacaccaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagacgaagaccacccccuucuccgugcccggguucagcguccaggagauguccaacagccgcuggccggccgcgaucuccgccaugguggugcggggcaacgagccccaggucgugcaguuccagaacgggcgcgcccaccuggacggcaugcugcucggcaccacgcccgucagccccaacuacaucgccagcuaccgggggaucuccaccggcaacagccgcuccgccagcuccgaggcggacgagcgggccguggggagcuucgacguguggguccgccugcaggagccggacggccagcccuacgacaucuucgggaagcagcccgccccgaucggcacccccgacuucaaggccgugaucgugggcuucgccgcgcggccccugaccuccgggagcuacgccaacgaggccuacgucaacacgaccgccuccgacuacgcgcccgccaccggcaacaugcgcuucaccgugcggaacgggggcacggggcacaucagcgccaacaaguacugggaguucaaguccuucggcguggagggcgagcgccacaccaacauccaguaccaggaguacgagcucccggacuacagcgggcaggucgccuccaaccacaaccuggccccgcccguggcgccccggaugcccggcgagagccugcuccuguuccaguccaacaugcccgugugggacgacgggcacggcgagagcacccccaagaagauccacugccugcucccccaggaguucaucgggcacuucuucgacaagcaggccccgucccugggcgacgccgcccugcuccgcuacgucaaccaggagaccaaccgggugcuguucgagugcaagcuguaccgcgacggcuacaucacgguggccgcgagcuccgggcuccuggacuucccccuggacggcuucuuccgcuucgacagcugggucagcuccuucuacauccucagccccgugggguccggccagggccggcgcgggcgggugcgcuuccaguga

SEQ ID NO: 10781 - RNA, 1623 nt, Artificial Sequence; identical to SEQ ID NO: 9927
  derived and/or modified sequence opt1 from capsid_protein_VP1__Norovirus__ADB27914

SEQ ID NO: 10782 - RNA, 1623 nt, Artificial Sequence; identical to SEQ ID NO: 8825
  derived and/or modified sequence opt1 from capsid_protein_VP1__Norovirus__ADI45809

SEQ ID NO: 10783 - RNA, 1623 nt, Artificial Sequence; identical to SEQ ID NO: 9382
  derived and/or modified sequence opt1 from capsid_protein_VP1__Norovirus__ADI45810

SEQ ID NO: 10784 - RNA, 1623 nt, Artificial Sequence; identical to SEQ ID NO: 8826
  derived and/or modified sequence opt1 from capsid_protein_VP1__Norovirus__ADI45813

SEQ ID NO: 10785 - RNA, 1608 nt, Artificial Sequence; identical to SEQ ID NO: 9048
  derived and/or modified sequence opt1 from capsid_protein_VP1__Norovirus__ADT70684

SEQ ID NO: 10786 - RNA, 1608 nt, Artificial Sequence; identical to SEQ ID NO: 9327
  derived and/or modified sequence opt1 from capsid_protein_VP1__Norovirus__ADZ24003

SEQ ID NO: 10787 - RNA, 1623 nt, Artificial Sequence; identical to SEQ ID NO: 9046
  derived and/or modified sequence opt1 from capsid_protein_VP1__Norovirus__AFI08234

SEQ ID NO: 10788 - RNA, 1623 nt, Artificial Sequence; identical to SEQ ID NO: 8835
  derived and/or modified sequence opt1 from capsid_protein_VP1__Norovirus__AFI08237

SEQ ID NO: 10789 - RNA, 1623 nt, Artificial Sequence; identical to SEQ ID NO: 8870
  derived and/or modified sequence opt1 from capsid_protein_VP1__Norovirus__AFI08243

SEQ ID NO: 10790 - RNA, 1593 nt, Artificial Sequence; identical to SEQ ID NO: 8983
  derived and/or modified sequence opt1 from capsid_protein_VP1__Norovirus__AFJ38516

SEQ ID NO: 10791 - RNA, 1620 nt, Artificial Sequence; identical to SEQ ID NO: 9276
  derived and/or modified sequence opt1 from capsid_protein_VP1__Norovirus__AFJ38519

SEQ ID NO: 10792 - RNA, 1623 nt, Artificial Sequence; identical to SEQ ID NO: 8840
  derived and/or modified sequence opt1 from capsid_protein_VP1__Norovirus__AFW15937

SEQ ID NO: 10793 - RNA, 1623 nt, Artificial Sequence; identical to SEQ ID NO: 8839
  derived and/or modified sequence opt1 from capsid_protein_VP1__Norovirus__AFW15939

SEQ ID NO: 10794 - RNA, 1623 nt, Artificial Sequence; identical to SEQ ID NO: 9441
  derived and/or modified sequence opt1 from capsid_protein_VP1__Norovirus__AFW15942

SEQ ID NO: 10795 - RNA, 1623 nt, Artificial Sequence; identical to SEQ ID NO: 8841
  derived and/or modified sequence opt1 from capsid_protein_VP1__Norovirus__AFW15943

SEQ ID NO: 10796 - RNA, 1623 nt, Artificial Sequence; identical to SEQ ID NO: 8842
  derived and/or modified sequence opt1 from capsid_protein_VP1__Norovirus__AFW15946

SEQ ID NO: 10797 - RNA, 1647 nt, Artificial Sequence; identical to SEQ ID NO: 9425
  derived and/or modified sequence opt1 from capsid_protein_VP1__Norovirus__AFX71656

SEQ ID NO: 10798 - RNA, 1629 nt, Artificial Sequence; identical to SEQ ID NO: 9423
  derived and/or modified sequence opt1 from capsid_protein_VP1__Norovirus__AFX71659

SEQ ID NO: 10799 - RNA, 1623 nt, Artificial Sequence; identical to SEQ ID NO: 8868
  derived and/or modified sequence opt1 from capsid_protein_VP1__Norovirus__AFX81124

SEQ ID NO: 10800 - RNA, 1623 nt, Artificial Sequence; identical to SEQ ID NO: 8889
  derived and/or modified sequence opt1 from capsid_protein_VP1__Norovirus__AFX81133

SEQ ID NO: 10801 - RNA, 1623 nt, Artificial Sequence; identical to SEQ ID NO: 9037
  derived and/or modified sequence opt1 from capsid_protein_VP1__Norovirus__AFX81151

SEQ ID NO: 10802 - RNA, 1623 nt, Artificial Sequence; identical to SEQ ID NO: 9088
  derived and/or modified sequence opt1 from capsid_protein_VP1__Norovirus__AFX81160

SEQ ID NO: 10803 - RNA, 1623 nt, Artificial Sequence; identical to SEQ ID NO: 8970
  derived and/or modified sequence opt1 from capsid_protein_VP1__Norovirus__AFX81175

SEQ ID NO: 10804 - RNA, 1623 nt, Artificial Sequence; identical to SEQ ID NO: 8885
  derived and/or modified sequence opt1 from capsid_protein_VP1__Norovirus__AFX81184

SEQ ID NO: 10805 - RNA, 1623 nt, Artificial Sequence; identical to SEQ ID NO: 8922
  derived and/or modified sequence opt1 from capsid_protein_VP1__Norovirus__AFX81187

SEQ ID NO: 10806 - RNA, 1623 nt, Artificial Sequence; identical to SEQ ID NO: 9129
  derived and/or modified sequence opt1 from capsid_protein_VP1__Norovirus__AFX81217

SEQ ID NO: 10807 - RNA, 1623 nt, Artificial Sequence; identical to SEQ ID NO: 9119
  derived and/or modified sequence opt1 from capsid_protein_VP1__Norovirus__AFX81220

SEQ ID NO: 10808 - RNA, 1623 nt, Artificial Sequence; identical to SEQ ID NO: 8941
  derived and/or modified sequence opt1 from capsid_protein_VP1__Norovirus__AFX81223

SEQ ID NO: 10809 - RNA, 1623 nt, Artificial Sequence; identical to SEQ ID NO: 8878
  derived and/or modified sequence opt1 from capsid_protein_VP1__Norovirus__AFX81235

SEQ ID NO: 10810 - RNA, 1623 nt, Artificial Sequence; identical to SEQ ID NO: 8920
  derived and/or modified sequence opt1 from capsid_protein_VP1__Norovirus__AFX81259

SEQ ID NO: 10811 - RNA, 1623 nt, Artificial Sequence; identical to SEQ ID NO: 8909
  derived and/or modified sequence opt1 from capsid_protein_VP1__Norovirus__AFX81280

SEQ ID NO: 10812 - RNA, 1623 nt, Artificial Sequence; identical to SEQ ID NO: 9061
  derived and/or modified sequence opt1 from capsid_protein_VP1__Norovirus__AFX81286

SEQ ID NO: 10813 - RNA, 1623 nt, Artificial Sequence; identical to SEQ ID NO: 8917
  derived and/or modified sequence opt1 from capsid_protein_VP1__Norovirus__AFX81310

SEQ ID NO: 10814 - RNA, 1623 nt, Artificial Sequence; identical to SEQ ID NO: 9138
  derived and/or modified sequence opt1 from capsid_protein_VP1__Norovirus__AGE89469

SEQ ID NO: 10815 - RNA, 1623 nt, Artificial Sequence; identical to SEQ ID NO: 9102
  derived and/or modified sequence opt1 from capsid_protein_VP1__Norovirus__AGE89484

SEQ ID NO: 10816 - RNA, 1623 nt, Artificial Sequence; identical to SEQ ID NO: 8939
  derived and/or modified sequence opt1 from capsid_protein_VP1__Norovirus__AGE89487

SEQ ID NO: 10817 - RNA, 1623 nt, Artificial Sequence; identical to SEQ ID NO: 8975
  derived and/or modified sequence opt1 from capsid_protein_VP1__Norovirus__AGE89619

SEQ ID NO: 10818 - RNA, 1623 nt, Artificial Sequence; identical to SEQ ID NO: 9084
  derived and/or modified sequence opt1 from capsid_protein_VP1__Norovirus__AGE89670

SEQ ID NO: 10819 - RNA, 1623 nt, Artificial Sequence; identical to SEQ ID NO: 8978
  derived and/or modified sequence opt1 from capsid_protein_VP1__Norovirus__AGE99596

SEQ ID NO: 10820 - RNA, 1653 nt, Artificial Sequence; identical to SEQ ID NO: 9421
  derived and/or modified sequence opt1 from capsid_protein_VP1__Norovirus__AGE99599

SEQ ID NO: 10821 - RNA, 1620 nt, Artificial Sequence; identical to SEQ ID NO: 9225
  derived and/or modified sequence opt1 from capsid_protein_VP1__Norovirus__AGE99612

SEQ ID NO: 10822 - RNA, 1647 nt, Artificial Sequence; identical to SEQ ID NO: 9426
  derived and/or modified sequence opt1 from capsid_protein_VP1__Norovirus__AGI17609

SEQ ID NO: 10823 - RNA, 1593 nt, Artificial Sequence; identical to SEQ ID NO: 8984
  derived and/or modified sequence opt1 from capsid_protein_VP1__Norovirus__AGM33211

SEQ ID NO: 10824 - RNA, 1593 nt, Artificial Sequence; identical to SEQ ID NO: 8989
  derived and/or modified sequence opt1 from capsid_protein_VP1__Norovirus__AGM33223

SEQ ID NO: 10825 - RNA, 1623 nt, Artificial Sequence; identical to SEQ ID NO: 9019
  derived and/or modified sequence opt1 from capsid_protein_VP1__Norovirus__AGT17839

SEQ ID NO: 10826 - RNA, 1617 nt, Artificial Sequence; identical to SEQ ID NO: 9018
  derived and/or modified sequence opt1 from capsid_protein_VP1__Norovirus__AGX85910

SEQ ID NO: 10827 - RNA, 1623 nt, Artificial Sequence; identical to SEQ ID NO: 9489
  derived and/or modified sequence opt1 from capsid_protein_VP1__Norovirus__AHI59162

SEQ ID NO: 10828 - RNA, 1620 nt, Artificial Sequence; identical to SEQ ID NO: 9446
  derived and/or modified sequence opt1 from capsid_protein_VP1__Norovirus__AHI59165

SEQ ID NO: 10829 - RNA, 1623 nt, Artificial Sequence; identical to SEQ ID NO: 9035
  derived and/or modified sequence opt1 from capsid_protein_VP1__Norovirus__AHX22044

SEQ ID NO: 10830 - RNA, 1623 nt, Artificial Sequence; identical to SEQ ID NO: 9068
  derived and/or modified sequence opt1 from capsid_protein_VP1__Norovirus__AII02587

SEQ ID NO: 10831 - RNA, 1647 nt, Artificial Sequence; identical to SEQ ID NO: 9053
  derived and/or modified sequence opt1 from capsid_protein_VP1__Norovirus__AII02617

SEQ ID NO: 10832 - RNA, 1647 nt, Artificial Sequence; identical to SEQ ID NO: 9141
  derived and/or modified sequence opt1 from capsid_protein_VP1__Norovirus__AIS24556

SEQ ID NO: 10833 - RNA, 1623 nt, Artificial Sequence; identical to SEQ ID NO: 9318
  derived and/or modified sequence opt1 from capsid_protein_VP1__Norovirus__BAI49908

SEQ ID NO: 10834 - RNA, 1623 nt, Artificial Sequence; identical to SEQ ID NO: 9155
  derived and/or modified sequence opt1 from capsid_protein_VP1__Norovirus__BAI49913

SEQ ID NO: 10835 - RNA, 1623 nt, Artificial Sequence; identical to SEQ ID NO: 9162
  derived and/or modified sequence opt1 from capsid_protein_VP1__Norovirus__BAI49922

SEQ ID NO: 10836 - RNA, 1608 nt, Artificial Sequence; identical to SEQ ID NO: 9170
  derived and/or modified sequence opt1 from capsid_protein_VP1__Norovirus__BAJ25074

SEQ ID NO: 10837 - RNA, 1617 nt, Artificial Sequence; identical to SEQ ID NO: 9180
  derived and/or modified sequence opt1 from capsid_protein_VP1__Norovirus__BAP33934

SEQ ID NO: 10838 - RNA, 1623 nt, Artificial Sequence
  derived and/or modified sequence opt1 from major_capsid_protein__Norovirus__ABQ63283
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgaggacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcacgaucgucgugcagccccagaacgggcgcugcaccaccgacggcguccuccuggggaccacgcagcucucccccgugaacaucugcaccuuccggggcgacgugacccacaucgccggcacccaggaguacacgaugaaccuggccagccagaacuggaacaacuacgacccgaccgaggagauccccgcgccccuggggacccccgacuucgucggcaagauccagggggugcucacccagacgacccgccgggacggcuccacccgcgggcacaaggccaccgugagcacgggcagcgucaacuucaccccgaagcugggccggauccaguucuccaccgacaccagcaacgacuucgagacggggcaguccacccgcuucacccccgugggcgugguccaggacgggagcaccacgcaccagaacgagccccagcagugggugcugcccgacuacuccggccgggacagccacaacgugcaccucgccccggccgucgcccccuccuuccccggggagcagcugcuguucuuccgcagcaccaugcccggcugcuccggcuacccgaacaugaaccucgacugccugcugccccaggagugggugcagcacuucuaccaggaggccgcccccgcgcagagcgacguggcccuccugcgguucgucaaccccgacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacgcuggcccccauggggaacggcaccggccgccgccgggcgcucuga

SEQ ID NO: 10839 - RNA, 1623 nt, Artificial Sequence
  derived and/or modified sequence opt1 from major_capsid_protein__Norovirus__ABV55634
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaaguggaacaaguacgaccccaccgaggagaucccggcgccccucggcacgcccgacuucguggggaagauccagggcguccugacccagaccaccaagggggacggcagcacgcggggccacaaggccaccaucuacaccggguccgcccccuucaccccgaagcugggcagcgugcaguucagcacggacaccgagaacgacuucgagacccaccagaacaccaaguucacgcccgugggggucacccaggacggcuccaccacccaccgcaacgagccccagcagugggugcuccccagcuacuccgggcggaacgugcacaacguccaccuggccccggccguggcgcccacguuccccggcgagcagcuccucuucuuccgcagcaccaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacgcucgcccccaugggcaacggcaccgggcgccggcgcgcccuguga

SEQ ID NO: 10840 - RNA, 1623 nt, Artificial Sequence
  derived and/or modified sequence opt1 from major_capsid_protein__Norovirus__ACV41093
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggagcaacuacgaccccacggaggagaucccggcgccccuggggacccccgacuucgugggcaagauccaggggaugcucacccagaccacgggccgcgacggguccacccggggccacaaggccaccguccugaccggcagcgccgacuucgcccccaagcuggggcgcgugcaguucgccacggacaccgacaacgacuucgagagcggcgagaacaccaaguucaccccggugggggucauccaggacggcuccacgacccaccggaacgagccccagcagugggugcuccccaacuacagcgggcgcaccggccacaacgugcaccuggcgcccgccgucgccccgaccuaccccggcgagcagcuccucuucuuccgguccacgaugcccgggugcagcggcuaccccaacauggaccuggacugccugcucccgcaggagugggugcgccacuucuaccaggaggccgcgcccgcccaguccgacguggcccugcugcgguucgucaaccccgacaccgggcgcgugcuguucgagugcaagcugcacaagcccggcuacgugaccgucgcccacaccgggcagcacgaccuggugaucccgcccaacggcuacuuccgcuucgacagcugggugaaccaguucuacacccucgcccccaugggcaacgggacgggccggcgccgggcgcuguga

SEQ ID NO: 10841 - RNA, 1635 nt, Artificial Sequence
  derived and/or modified sequence opt1 from major_capsid_protein__Norovirus__ACV41096
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucauggccuucgccgcgcccgccccggccggcuuccccgaccugggguccugcgacuggcacaucgagaugagcaagauccccaacagcuccacgcagaacaaccccaucguggugaacagcgucaagccgaacucccagcaguucgugccccaccucagcuccaucacccuggacgacaacgugagcuccggcggggacuacaucggcaccauccaguggaccagcccgcccuccgacagcgggggcgccaacacgaacuucuggaagauccccgacuacggcuccagccuggccgaggcgucccagcucgcccccgccgucuacccgcccggguucaacgaggugaucguguacuucauggccagcauccccggccccaaccaguccgggagccccaaccugguccccugccugcucccgcaggaguacaucacccacuucaucuccgagcaggcccccauccagggcgaggcggcccugcugcacuacguggaccccgacaccaaccgcaaccucggggaguucaagcuguaccccggcggcuaccugaccugcgugccgaacagcuccagcacggggccccagcagcucccccuggacggcgucuucguguucgccagcugggugucccgguucuaccagcugaagcccgucgggaccgccggcccggcgcgcggccggcucggggugcgccgguga

SEQ ID NO: 10842 - RNA, 1743 nt, Artificial Sequence
  derived and/or modified sequence opt1 from major_capsid_protein__Norovirus__ACV88130
augaagauggccagcaacgacgccaccgcgcccucccaggacggcgccgccaaccuggugccggagagccagcacgagguccucgcccuggagcccguggccggggcggcccuggccgcccccguggcgggccaguucaacgccaucgaccccuggaucaagcagaacuucguccaggccccggccggggaguucaccgugagcccccgcaacgcccccggcgagauccucauggaccuggagcuggggcccgagcucuccccguuccuggcgcaccuggcccagauguacaacgccuacgccggcggcauggaggugcagaucauccucgccgggaacgcguucacggccggcaagaucaucgucugcgccgugccgcccaacuucccgcccgaccggcuguccgccagccaggccaccaacuucccccacgugaucauggacguccgcacccuggagcccgugauccucccccugcccgacgugcgggcgggguucuuccacuacaaccagcugcgcgagccccggaugcgccucauggcccugcuguacacgccccuccgggccaacggcaccggggacgacgccuucaccgucuccugccgcgugcugacccggcccaugcaggacuucgaguucauguuccuggugccgcccaccgucgagagccgcgugacgcccuucuccgugcccaccuacccggucguggagaugaccaacagccgguggcccgcccgcaucuccggcaugcacgugaacgcgaaccagacccucgccguccaguuccagaacggccggugcacgcuggacgggcagcugaugggcaccacccagcucugcgccgccgacgugugccgcaugcgggggcgcuacaccagcacgcgggcggaccuggccggcguggaccacaccgaccagggccccucccugggggccggccccagcaacgacccggucuccgugcccgaggcccgcagccagacccggaccuccgucagcgcccaccuccagcuggaggagcugaacgggcagcccuacgagguguacggcgagcagccggcgccccucgggacgcccgacuucugcugccgccugaugggcgagcuggugcggcuccccuccaccagcccggccgcccagagccgcuuccgcgacgccuucuucgacaccuacggcgcccuguucgcgcccgccgucggguccaccacguucaccgugaacaacagcuccaccagcgacuucgccaacggccagcccuucgaguuccugcccaucgggguggagaucggcaacuccgcccaguacgacgaguucgcccucccgagcuacaacggggcgaucggcgagaaccggcaccuggcccccgucgccgcccccggcuuccccggggagaacaucguguucuucuccagcaaccugccggugugggacuccaccagcgcgcagaacaaccgccggaucuccugccuccugcccaacgaguucguccagcacuucuacgaccugcaggcccccagccaguccgacguggcccuccugcgcuacgugcaccccgagagcggccggguccuguucgagugcaagcucuaccgcgacggguuccugacggugaacggcgccucccuggccgaguucccggugaacggguacuuccgguucgacagcugggucaaccaguucuucacccucucccccgugggcaccggcagcgggcgcuccggccggagccgcaacgcgcaguga

SEQ ID NO: 10843 - RNA, 1623 nt, Artificial Sequence; identical to SEQ ID NO: 9989
  derived and/or modified sequence opt1 from major_capsid_protein__Norovirus__ACW19927

SEQ ID NO: 10844 - RNA, 1623 nt, Artificial Sequence
  derived and/or modified sequence opt1 from major_capsid_protein__Norovirus__ACX31885
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcacggggcgccggcgcgcgcuguga

SEQ ID NO: 10845 - RNA, 1623 nt, Artificial Sequence
  derived and/or modified sequence opt1 from major_capsid_protein__Norovirus__ACX31887
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccaacuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucauccccuccaacggguacuuccgguucgacagcugggugaaccaguucuacacccucgcccccaugggcaacggcacggggcgccggcgcgcccuguga

SEQ ID NO: 10846 - RNA, 1623 nt, Artificial Sequence
  derived and/or modified sequence opt1 from major_capsid_protein__Norovirus__ACX31891
augaagauggccagcuccgacgccagccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccugagccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucaccggcagccggaacuacacgaugaaccuggccucccagaacuggaacaacuacgaccccaccgaggagaucccggcgccccuggggacccccgacuucgugggcaagauccaggggaugcucacccagacgacccgcggcgacgggagcacccggggccacaaggccaccgucuacacgggcagcgccgacuucgcccccaagcuggggcgcgugcaguucgccaccgacaccgacaacgacuucgaguccaaccagaacaccaaguucacgccggugggcgucauccaggacgggaacaccacccaccagaacgagccccagcagugggugcugcccggcuacagcgggcgggacggccacaacgugcaccucgcccccgcggucgccccgaccuaccccggcgagcagcugcuguucuuccgcuccacgaugcccgggugcagcggcuaccccaacaugaaccucgacugccugcugccgcaggagugggugcagcacuucuaccaggaggccgcccccgcgcaguccgagguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccaugggcaacggggccggccgccgccgggcgcucuga

SEQ ID NO: 10847 - RNA, 1623 nt, Artificial Sequence
  derived and/or modified sequence opt1 from major_capsid_protein__Norovirus__ACZ37232
augaagauggccagcaacgacgccgcgcccuccaacgacggcgccgccgggcuggugcccgagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacuccggcgacgacgucuucaccgugagcugccgggugcucaccaagccgucccccgacuucgaguucaccuuccuggucccgcccaccguggagagcaagaccaagcaguucacgcugcccauccucaagaucuccgagaugaccaacagccgcuuccccgugcccgucgagaugauguacaccgcccggaacgagaaccagguggugcagccccagaacgggcgcgucacccuggacggcgagcugcucgggacgaccccgcugcuggcggugaacaucugcaaguucaagggcgaggugaucgccaagaacggcgacguccgguccuaccgcauggacauggagaucaccaacaccgacgggacgcccaucgaccccaccgaggacaccccgggccccaucgggagccccgacuuccagggcauccucuucgggguggccucccagcggaacaccaacgagcccaacccggccacgcgcgcccacgaggcgaacaucaacaccggcggcgaccaguacgcccccaagcuggcccaggucaaguucuucagcgagucccaggacuucgaggugcaccagcccaccguguucacccccgucgggguggccggcgacacgagccacccguuccggcagugggugcugccccgcuacgggggccaccucaccaacaacacccaccuggcccccgcggucgcgccccuguucccgggggagcagauccucuucuuccggucccagauccccagcagcggcggccacgagcugggguacauggacugccuggugccccaggagugggugcagcacuucuaccaggaggccgccaccgcccaguccgaggucgcccucauccgcuucaucaaccccgacacgggccgggugcuguucgaggccaagcugcacaagcagggguucaucaccguggcccacaccggcgacaacccgaucgucaugccgcccaacggguacuuccgcuucgaggccugggugaaccaguucuacagccucgcgcccgugggcaccggcaacgggcggcgccgcauccaguga

SEQ ID NO: 10848 - RNA, 1623 nt, Artificial Sequence; identical to SEQ ID NO: 8842
  derived and/or modified sequence opt1 from major_capsid_protein__Norovirus__ADD10375

SEQ ID NO: 10849 - RNA, 1623 nt, Artificial Sequence
  derived and/or modified sequence opt1 from major_capsid_protein__Norovirus__ADO85552
augaagauggccagcuccgacgccaaccccagcgacggcuccaccgcgaaccuggugcccgaggucaacaacgaggugauggcccucgagcccguggucggggccgccagcgccgcgcccguggccggccagcagaacgugaucgaccccuggauccgcaacaacuucguccaggcccccgggggcgaguucaccgagucccccacgaacgcccccggggagauccuguggagcgcgccccugggcccggaccucaaccccuaccugucccaccuggcccggauguacaacggcuacgccgggggcuucgagguccaggugauccucgccgggaacgccuucaccgcgggcaagaucaucuucgccgccgugccgcccaacuucccgaccgaggggcugagccccucccaggugaccauguucccccacaucaucguggacguccgccagcuggagcccgugcucaucccgcugcccgacgugcggaacaacuucuaccacuacaaccagagcaacgaccccacgaucaagcugaucgccaugcucuacacgccccugcgcgccaacaacgcgggcgacgacgucuucaccguguccugccgggugcugacccgcccgagccccgacuucgacuucaucuuccucguccccgccaccguggagucccggaccaagcccuucagcgugccgguccugaccguggaggagaugaccaacucccgcuuccccaucccccuggagaagcuguucacgggccccagcuccgccuucgugguccagccgcagaacgggcggugcaccaccgacggcgugcuccuggggaccacgcagcucagccccgucaacaucugcaccuuccgcggcgacgugacccacauccccggcucccggaacuacaccaugaaccuggccagccagaacuggaacagcuacgacccgacggaggagauccccgcccccguggggacccccgacuucgucggcaagauccagggggugcugacccagaccacgcgcaccaacggcuccacccgggggcacaaggcgaccguguacacgggcagcgccgacuucuccccgaagcucggccgcguccaguucgccaccgacaccgacaacgacuucgagaccaaccagaacacgaaguucacccccgugggggugauccaggacggcagcaccacgccccggaacgagccccagcaguggguccugccguccuacagcgggcgcaacauccacaacgugcaccuggcccccgccguggcgcccaccuuccccggcgagcagcuccuguucuuccgguccaccaugccggggugcagcggcuaccccaacauggaccuggacugccuccugccccaggaguggguccaguacuucuaccaggaggccgcccccgcccaguccgacguggcgcugcuccgcuucgugaacccggacaccggccggguccuguucgagugcaagcugcacaagagcggguacgugaccguggcccacaccggccagcacgaccucgucaucccgcccaacggguacuuccgcuucgacuccugggugaaccaguucuacacgcuggcccccaugggcaacgggaccggccggcgccgcgcccuguga

SEQ ID NO: 10850 - RNA, 1623 nt, Artificial Sequence
  derived and/or modified sequence opt1 from major_capsid_protein__Norovirus__ADQ43779
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggcccuccccuccuacagcgggcggaacgugcagaacguccaccuggccccggcgguggcccccaccuuccccggcgagcagcuccucuucuuccgcuccacgaugcccggcugcagcggguacccgaacauggaccuggacugccugcucccccaggagugggugcagcacuucuaccaggaggccgcccccgcgcaguccgacgucgcccugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 10851 - RNA, 1623 nt, Artificial Sequence; identical to SEQ ID NO: 8882
  derived and/or modified sequence opt1 from major_capsid_protein__Norovirus__ADQ43781

SEQ ID NO: 10852 - RNA, 1623 nt, Artificial Sequence; identical to SEQ ID NO: 9382
  derived and/or modified sequence opt1 from major_capsid_protein__Norovirus__ADQ43783

SEQ ID NO: 10853 - RNA, 1623 nt, Artificial Sequence; identical to SEQ ID NO: 9382
  derived and/or modified sequence opt1 from major_capsid_protein__Norovirus__ADV37805

SEQ ID NO: 10854 - RNA, 1623 nt, Artificial Sequence; identical to SEQ ID NO: 9382
  derived and/or modified sequence opt1 from major_capsid_protein__Norovirus__ADV37807

SEQ ID NO: 10855 - RNA, 1623 nt, Artificial Sequence; identical to SEQ ID NO: 9382
  derived and/or modified sequence opt1 from major_capsid_protein__Norovirus__ADV37809

SEQ ID NO: 10856 - RNA, 1623 nt, Artificial Sequence
  derived and/or modified sequence opt1 from major_capsid_protein__Norovirus__ADV37813
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccugcuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgaccuggagaccaaccagaacaccaaguucacgcccgugggggugauccaggacggcuccaccacgccccgcaacgagccgcagcaguggguccuccccagcuacuccgggcggaacauccacaacgugcaccuggcccccgccguggcccccaccuucccgggcgagcagcuccucuucuuccgcagcaccaugcccgggugcuccggcuaccccaacauggaccuggacugccugcucccccaggaguggguccaguacuucuaccaggaggcggccccggcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacccucgcccccaugggcaacgggacgggccgccgccgggcccuguga

SEQ ID NO: 10857 - RNA, 1623 nt, Artificial Sequence
  derived and/or modified sequence opt1 from major_capsid_protein__Norovirus__ADV37917
augaagauggccagcuccgacaccaagaccagcgacggcuccacggccaaccuggugcccgaggucaacaacgaggugauggcgcucgagccgguggucggggccgccaucgccgcccccguggcgggccagcagaacgugaucgaccccuggauccgcaacaacuucguccaggcccccgggggcgaguucaccgugagcccgcggaacgcccccggggagauccugugguccgcgccccugggccccgaccucaacccguaccugagccaccuggcccgcauguacaacggcuacgccgggggcuucgaggugcaggucauccucgccgggaacgccuucaccgccggcaagaucaucuucgcggccgugccgcccaacuuccccaccgaggggcugucccccagccaggugacgauguucccccacaucaucgucgacgugcggcagcuggagcccgugcucaucccccugccggacguccgcaacaacuucuaccacuacaaccaguccaacgaccccaccaucaagcugaucgccaugcucuacacgccccugcgggccaacaacgccggcgacgacguguucaccgugagcugccgcguccugacccggcccuccccggacuucgacuucaucuuccucgugccgcccaccguggagagccgcaccaagcccuucuccguccccauccugaccguggaggagaugacgaacagccgguuccccaucccccuggagaagcuguucaccggccccuccagcgcguucgugguccagccgcagaacgggcgcugcaccaucgacggcgugcuccuggggaccacgcagcucucccccgucaacaucugcaccuuccggggcgacgugacccacaucaccggcagccgcaacuacacgaugaaccuggccacccagaacuggaacuccuacgaccccaccgaggagaucccggcgccccuggggacccccgacuucgugggcaagauccaggggguccucacgcagaccacccgggccgacggcagcacccgcgggcacaaggccacgguguacaccggcagcgccgacuucgcccccaagcugggccgggugcaguucgccaccgacaccgacaacgacuucgacgccaaccagaacacgaaguucaccccggucggggugauccaggacggcaacaccgcccaccgcaacgagccccagcagugggugcugcccuccuacagcgggcggaacucccacaacguccaccucgcgcccgccguggccccgaccuuccccggcgagcagcugcuguucuuccgcagcacgaugcccgggugcuccggcuaccccaacauggaccucgacugccugcugccgcaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcgcucuga

SEQ ID NO: 10858 - RNA, 1623 nt, Artificial Sequence
  derived and/or modified sequence opt1 from major_capsid_protein__Norovirus__ADV37919
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaucgacggcgugcuccuggggaccacccagcucucccccgucaacaucugcaccuuccggggcgacgugacgcacaucaccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgccaaccagaacaccaaguucacccccgucggggugauccaggacggcaacacggcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucacgguggcccacaccggccagcacgaccuggugaucccgcccaacggguacuuccgguucgacagcugggucaaccaguucuacacccuggcgcccaugggcaacgggaccggccgccgccgggcccucuga

SEQ ID NO: 10859 - RNA, 1608 nt, Artificial Sequence
  derived and/or modified sequence opt1 from major_capsid_protein__Norovirus__AEI83469
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggagaaccacguguggaacaugcaggucacgaacaucaacggcacccccuucgacccgaccgaggacgugcccgcgccccuggggacccccgacuucuccggcaagcuguucggggugcucagccagcgcgaccacgacaacgccugccggucccacgacgccgucaucgccacgaacagcgccaaguucaccccgaagcugggcgcgauccagaucggcaccugggaggaggacgacgugcacaucaaccagcccaccaaguucacgcccgugggccucuucgagagcgagggguucaaccaguggacccugcccaacuacuccggggcccugacccucaacaugggccuggccccgcccgucgcccccaccuuccccggggagcagauccuguucuuccgcagccacaucucccucaagggcggcguggccgacccggugaucgacugccugcugccccaggaguggauccagcaccucuaccaggagagcgcgcccucccagacggacgucgcccugauccgguucaccaaccccgacaccgggcgcgugcuguucgaggccaagcuccaccggagcggcuacaucaccguggccaacacggggucccgcccgaucgucgugcccgcgaacggcuacuuccgguucgacagcugggugaaccaguucuacucccuggcccccauggggaccggcaacggccgccgccggguccaguga

SEQ ID NO: 10860 - RNA, 1644 nt, Artificial Sequence
  derived and/or modified sequence opt1 from major_capsid_protein__Norovirus__AEP04093
augaagauggccagcaacgacgccgcgcccuccaccgacggcagcgccgggcuggugccggaggucaacaacgagaccauggcccucgagcccguggugggcgcgccccuggccgcccccgucgccgggcagcacaacaucaucgacccguggaucaagaugaacuucgugcaggcccccaacggcgaguucacggugagcccccgcaacgcccccggggagauccugcucgaccuggagcugggcccggaccucaaccccuaccugucccaccuggcgcggauguacaacggcuacgccgggggcauggagguccagguggugcucgccgggaacgccuucaccgccggcaagaucaucuucgcggccgucccgcccaacuuccccgccgagaaccuguccgccgcccaggugaccaugugcccccacgugaucgucgacgugcgccagcuggagcccgugaugcuccccaugccggacauccggaacaagcuguuccacuacaaccaggucgacgaccccaagcugcgccuccuggcguaccuguacacgccccuccgggccaacaacgccggggacgacguguucaccgugagcugccgcguccugacccggcccaccccggacuucgaguucauguuccuggugccgcccaccguggaguccaagacgaagcccuucagccuccccucccugacccuggacgagcucagcaacucccgcuuccccgcccccaucguccagcuguacaccaacccccacgacaaccugguggugcagccgcagaacggccggugcaccaucgacggccuccugcaggggacgacccagcuggucagcugcaacgugugcuccuuccgcggcaccaucggggacggccagcccgccagccacuccgaggaggagaucaugcccauggcguucaacauccagcgggagcucaugcuggagaaccuggacggcagcccguacgaccccaccgacgacauccccgccguccucgggucccccgacuuccagggcgugaucuucgggauccugagccagcgcaacggcgacgggcagacgcgggcccacgaggccaagguggacacccgcgccgcgcgguucgccccgaagcugggcuucgucguggccaccguggaguccaccgacuuccacgccaaccagcccagccgcuucacgcccgucggccucgggggcgacgggaaccaggacuucgcgcaguggaaccugcccaccuacggcggggcccugaccaacaacaccaaccucgccccgcccgugaugcccguguaccccggcgagcagcugcuguucuuccggagccagcucccguccagcggcggggucgugggcggguggcuggacugccugcucccccaggagugggugcagcacuucuuccaggaguccgccacgagccaguccgacgucgcccuggugcgcuacaucaaccccaccaccggccgggugcuguucgaggcgaagcuccacaagcagggguuccugaccgucgccgccagcggcuccuacccccugguggugccggccgacggcuacuuccgcuucgagagcugggucaaccaguucuacacgcuggcccccauggggaacggcuccgggcggcgccgcacccgguga

SEQ ID NO: 10861 - RNA, 1620 nt, Artificial Sequence
  derived and/or modified sequence opt1 from major_capsid_protein__Norovirus__AEQ77282
augaugauggccagcaaggacgcccccuccaacauggacggcaccagcggggcgggccagcuggugccggaggucaacgccgccgagccccucccccuggagcccguggugggggccgccaccgcggccgccacggccggccaggucaaccugaucgacccguggaucaugaacaacuucgugcaggcgcccgagggggaguucaccaucucccccaacaacacccccggcgacauccucuucgaccugcaccugggcccgcaccucaaccccuuccugcagcaccugagccagauguacaacgggugggugggcaacaugcgcguccgggugaugcucgccgggaacgccuucaccgccggcaagaucaucaucugcugcgugccgcccggguucgccucccagaacaucagcaucggccaggcgacgauguucccccacgucaucgccgacgugcgcgugcuggagcccaucgagaucccccuggacgacguccggaacguccucuuccacaccaacgagaaccgccccaccaugcggcugcugugcaugcucuacaccccgcugcgcgccggcggggccuccagcggcacggaccccuucgugaucgccgggcgggugcugaccugccccucccccgacuucaacuuccucuuccuggugccgcccagcguggagcagaagacccgccagcugaccguccccaacaucccccucaacaaccuggcgaacucccgggugccggccaugaucaacaagaugacggugagcaccgaccagaaccaggucgugcaguuccagaacggccgcugcacccuggagggccagcuccuggggaccacgcccguguccgccagccaggucgcccggauccgcggcaagguguucuccaccgccagcgggaagggccugaaccucaccgagcuggacgggacccccuaccacgcguucgagucccccgccccgcugggcuuccccgacaucggcgccugcgacuggcacgucagcacguucaagguggaccagaaccucuccggggaccccaugagccggcuggacgugaagcagaacgccccguucgcgccccaccugggcagcaucgaguucaccuccgaccaggaccccaccggggaccagcucggcacccuggcgugggucagccccuccacgagcggggcccgcguggacccguggaagauccccuccuacggcagcaccgugaccgaguccacccaccuggccccgcccaucuucccgcccggcuucggggaggccaucgucuacuucaugagcgacuuccccaucguguccggcaacacggcccaggugcccugcacccucccccaggaguucgucagccacuucguggagcagcaggcccccgugcgcggggaggccgcccugcugcacuacgucgaccccgacacccaccggaaccucggcgaguucaagcuguaccccgacggguucaucacgugcgugccgaacaccggcggcgggccccagaaccugcccaccaacggcguguucgucuucuccagcugggugucccgguacuaccagcucaagcccguggggaccgccggcccggcgcgccggcugggcguccgccggguguga

SEQ ID NO: 10862 - RNA, 1608 nt, Artificial Sequence
  derived and/or modified sequence opt1 from major_capsid_protein__Norovirus__AFA55174
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggaggugcugcucaaccuggagcugggccccgagcucaacccguuccuggcccaccugucccgcauguacaacggcuacgccgggggcgucgagguccaggugcuccuggccgggaacgccuucaccgccggcaagcugguguucgcggccaucccgccccacuucccccucgagaaccugagccccgggcagaucaccauguucccccacgugaucaucgacgugcggacccuggagcccguccuccugccccugccggacgugcgcaacaacuucuuccacuacaaccagcagcccgagccccggaugcgccucguggccaugcuguacacgccccugcgguccaacggcagcggcgacgacgucuucaccguguccugccgcgugcucacccggccgagccccgacuucgacuucaacuaccuggucccgcccaccguggaguccaagacgaagcccuucacccugcccauccucaccaucggggagcugagcaacucccgcuuccccgugcccaucgacgagcuguacaccagcccgaacgagggcgucguggugcagccccagaacgggcgguccacgcucgacggcgagcugcugggcaccacccagcucguccccagcaacaucugcgcccugcgcgggcggaucaacgcccaggugccggacgaccaccaccaguggaaccugcaggucaccaacgcgaacggcacguccuucgaccccaccgaggacgugcccgcgccccucgggaccccggacuuccuggccaacaucuacggcgugaccagccagcgcaaccccgacaacacgugccgggcccacgacgggguccuggccaccuggucccccaaguucacccccaagcucggcagcguggugcugggcaccugggaggagagcgaccuggaccucaaccagccgacgcgcuucacccccgucgggcuguacgacaccggccacuucgaccagugggugcugcccaacuacuccgggcggcucacccugaacaugaaccuggcccccagcguggccccgcuguuccccggcgagcagauccucuucuuccgcucccacaucccccugaagggcgggacgagcaacggcgccaucgacugccuccugccccaggaguggauccagcacuucuaccaggaguccgccccgagccccaccgacgucgcccugauccgguacaccaaccccgacaccgggcgcgugcuguucgaggcgaagcuccaccggcagggcuucaucacgguggccaacuccgggagccgccccaucgucgugccgcccaacggcuacuuccgcuucgacuccugggugaaccaguucuacagccuggcccccauggggaccggcaacggccggcgccggguccaguga

SEQ ID NO: 10863 - RNA, 1629 nt, Artificial Sequence
  derived and/or modified sequence opt1 from major_capsid_protein__Norovirus__AFC89656
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucuccaucgagcagcuguacaccgcgccgaacgagaacaacgucgugcagugccagaacggccggugcacccucgacggcgagcugcaggggaccacgcagcugcucagcuccgccgugugcagcuaccgcggccggaccgucgccaacuccggggacaacugggaccagaacgugcugcagcugaccuaccccagcggcgccagcuacgaccccaccgacgaggugccggcgccccucggcacgcaggacuucuccgggauccuguacggcguccugacccaggacaacgugcgcgagaacaccggggaggccaagaacgccaagggcgucuacaucagcaccacguccgggaaguucacccccaagaucggcagcaucggccuccacuccaucaccgaggacgugcggcccaaccagcagagccgcuucaccccggugggggucgcccagaacgagaacacgcccuuccagcagugggugcugccccacuacgccggcgcccuggcgcucaacaccaaccuggcccccgccguggccccgaccuuccccggggagcagcuccuguucuuccggucccgcguccccugcgugcagggccugcaggggcaggacgcguucaucgacugccugcucccccaggagugggugaaccacuucuaccaggaggccgccccgagccaggccgacgucgcccugauccgguacgugaaccccgacaccggccgcacgcuguucgaggcgaagcuccaccgguccggcuucaucaccgugagccacaccggggccuacccccuggucgugcccccgaacggccacuuccgcuucgacuccugggugaaccaguucuacagccuggcccccauggggaccggcaacgggcgccggcgcguccaguga

SEQ ID NO: 10864 - RNA, 1617 nt, Artificial Sequence
  derived and/or modified sequence opt1 from major_capsid_protein__Norovirus__AFC89659
augaugauggccagcaaggacgcccccuccaacauggacggcaccagcggggcgggccagcuggugccggaggucaacaccgccgagccccucccccuggagcccguggugggggccgccacggccgcggccaccgccggccaggucaaccugaucgacccguggaucaugaacaacuucgugcaggcccccgagggggaguucaccaucucccccaacaacacccccggcgacauccucuucgaccugcgccugggcccgcaccucaaccccuuccugcugcaccucagccagauguacaacgggugggugggcaacaugcggauccgcgucaugcuggcggggaacgccuucuccgccggcaagaucaucaucugcugcgugccgcccggguucgagagccagaacaucuccaucggccaggccacgauguucccccacgugaucgccgacguccgggugcuggagcccaucgagaucccccucgacgacgugcgcaacguccuguaccacaccaacgagaaccggcccaccaugcgccugcucugcaugcuguacaccccgcugcgggcgggcggggccagcuccggcacggaccccuucgugaucgccgggcgcgugcugaccugccccgcccccgacuucaacuuccucuuccuggucccgcccagcguggagcagaagacccggcagcucaccauccccaacaucccccugaacaaccuggccaacucccgcgugccggcgaugaucaacaagauggccgucagcgccgaccagaaccagguggugcaguuccagaacggccggugcacgcucgagggccagcugcuggggaccacccccgucuccgccaaccagguggcccgcauccggggcaagguguucagcaccaacuccgggacgggccucaaccugaccgagaccgacgggacccccuaccacgcguucgagagccccgccccgcugggcuuccccgacaucggcgacugcgacuggcacgucuacgccuucaaggugaaccagaacacgggggaccccauguaccgccucgacaucacccagggcaacuccuucgccccgcaccuggggagcaucgaguucaccuccgaccagcaccccagcggcgaccagcuggggacccucacguggaucagcccccugaacaacgccucccgggucgaccccuggaagaucccgagcuacggcuccacccugaccgagagcaccaaccucgcgccgcccaucuucccgcccggcuucggggaggccaucguguacuucauguccgacuuccccaucgugagcggcaacacgacccagauccccugcacccugccccaggaguucaucuccagcuucgucgagcagcaggcccccauccgcggggaggccgcgcugcuccacuacguggaccccgacacccaccggaaccugggcgaguucaagcuguaccccgacggguucaucacgugcgugcccaacaccggcggcgggccgcagaaccuccccuccaacggcgucuucaucuucagcuccugggugagccgcuacuaccagcugaagcccguggggaccgccggccccgcccggcgccugggcguccggcgcaucuga

SEQ ID NO: 10865 - RNA, 1647 nt, Artificial Sequence
  derived and/or modified sequence opt1 from major_capsid_protein__Norovirus__AFC89662
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaccgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacacgccgcuccgcgccaacaacuccggcgacgacgucuucaccgugagcugccgggugcugacccgccccucccccgacuucagcuucaacuuccuggugcccccgaccguggaguccaagacgaagcccuucacccuccccauccugaccaucagcgagauguccaacagccgguuccccgugccgaucgacucccugcacaccagccccacggagaacaucgucgugcagugccagaacgggcgcgugacccucgacggcgagcugauggggaccacccagcugcuccccucccagaucugcgccuuccggggcguccugacgcgcagcaccucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagaucuucggcguggccagccagcgcaaccccgacuccaccacccgggcccacgaggcgaagguggacacgaccgccgggcgcuucacccccaagcucggcagccuggagaucuccaccgagagcggcgacuucgaccagaaccagccgacgcgguucacccccgucgggaucggcguggacaacgaggccgacuuccagcaguggucccugcccgacuacagcgggcaguucacccacaacaugaaccucgcccccgcggucgccccgaacuuccccggcgagcagcugcuguucuuccgcucccagcuccccagcuccgggggccggagcaacggcauccuggacugccuggugccccaggagugggugcagcacuucuaccaggaguccgccccggcccagacccaggucgcccucgugcgcuacgugaaccccgacacggggcgcguccuguucgaggcgaagcugcacaagcucggcuucaugaccaucgccaagaacggggacagccccaucaccgugcccccgaacggcuacuuccgguucgaguccugggugaaccccuucuacacccuggcccccauggggacgggcaacggccgccggcgcauccaguga

SEQ ID NO: 10866 - RNA, 1620 nt, Artificial Sequence
  derived and/or modified sequence opt1 from major_capsid_protein__Norovirus__AFC89665
augaagauggccagcaacgacgccgcgcccuccaacgacggcgccaccgggcuggugccggagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugagccgcauguacaacggcuacgccgggggcguggaggugcagguccugcucgccgggaacgccuucaccgccggcaagauccuguucgccgcggugccgcccaacuuccccguggacaugcugucccccgcccagaucacgaugcucccccaccugaucgucgacgugcggacccuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacgcggcccacccccgacuucgaguucaccuaccuggugcccccguccgucgagagcaagaccaagcccuucacgcuccccauccugaccaucggcgagcugaccaacucccgcuuccccgccccgaucgaccagcucuacaccagccccaacgcggacguggugguccagccccagaacgggcggugcacgcuggacggcgagcugcaggggaccacccagcuccugaccacggccaucugcuccuaccgcggcaugaccagcaacccgaccuccgacuacugggacgaccaccuccugcaccuggugcaccccaacggcgccaccuacgaccccacggaggacgugcccgccccguucgggacccaggacuuccggggcauccuguacgggaugcucacccagaacccccgcaccagcggcgacgaggccgcgaacucccacgggaucuacaucagcuccacgagcgagaaguucacccccaagcugggcaccaucggccugcaccagguccagggggacaucgccagcaaccagcaguccaaguucacccccgugggcaucgccgucaacgggaacacgccguuccggcagugggagcuccccaacuacagcggcgcccugacccugaacaccaaccucgcccccgcgguggggcccaacuucccgggcgagcagauccuguucuuccgcuccaacgugcccagcguccagggcgggcagcccaucgagaucgacugccugaucccccaggagugggugucccacuucuaccaggagagcgccccgucccagagcgacguggcccucguccgguacgugaaccccgacaccggccgcacgaucuucgaggccaagcugcaccggcagggguucaucaccaucgcggccaccggcuccaaccccguggucgugcccccgaacggguacuuccgcuucgacagcugggugaaccaguucuacgcccuggcccccaugggcaccggcaacgggcggcgccgcguccaguga

SEQ ID NO: 10867 - RNA, 1623 nt, Artificial Sequence; identical to SEQ ID NO: 9292
  derived and/or modified sequence opt1 from major_capsid_protein__Norovirus__AFC89667

SEQ ID NO: 10868 - RNA, 1626 nt, Artificial Sequence
  derived and/or modified sequence opt1 from major_capsid_protein__Norovirus__AFD62272
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaccggccagguggccacguucaccaugaucgagcaggacgggagcgcguacgugcccggggaccgggccgcgccccugggcuacccggacuacuccggccagcuggagaucgagguccagaccgagaccacgaaggccggggacaagcucaaggugaccaccuucgagaugauccugggccccaccacgaacguggaccaggcccccuaccaggggcgcgccuacgccagccugaccgccgccgcgagccucgaccuggucgacggccgggugcgcgccgugccccgguccaucuacagcuuccaggacguccugccggaguacaacgacgggcuccuggugccccuggccccgccccucggccccuuccugcccggcgaggugcugcuccgcuuccggaccuacaugcgccagcuggacaccgccgacgccgcggcccagcccaucgacugcgcccugccccaggaguucgucuccugguucgccagcaacuccuucacggugcagagcgacgcccuccuggugcgguaccgcaacacccugaccgggcagcuccuguucgaggcgaagcuguacuccgagggcuacaucgccgucagcuacuccgggagcggcccgcugaccuuccccgccgacggguucuucgaggugguguccugggucccccgccucuuccagcuggccagcgugggcucccuggcgacgggccggacccucaagcaguga

SEQ ID NO: 10869 - RNA, 1620 nt, Artificial Sequence
  derived and/or modified sequence opt1 from major_capsid_protein__Norovirus__AFJ04707
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacaucacccacaucgccggcucccacgacuacaccaugaaccuggccagccagaacuggagcaacuacgaccccaccgaggagauccccgcgccgcuggggacgcccgacuucgugggcaagauccaggggaugcucacccagaccacccgcgaggacggcuccacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcgggaaccaccagaacgagccgcagcagugggugcugcccaacuacuccggccgcaccgggcacaacgugcaccucgcccccgccgucgcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacguggcgcuccugcgcuucgucaaccccgacaccggccgggugcuguucgagugcaagcuccacaaguccggguacgugaccgucgcccacaccggcccccacgaccuggugaucccgcccaacggguacuuccgcuucgacagcugggugaaccaguucuacacccuggcccccaugggcaacggcgccgggcggcgccgggcccucuga

SEQ ID NO: 10870 - RNA, 1623 nt, Artificial Sequence
  derived and/or modified sequence opt1 from major_capsid_protein__Norovirus__AFJ04708
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcgcccaccagaacgagccccagcagugggugcugcccuccuacagcggccggaccgggcacaacguccaccucgccccggccguggcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaaguccggcuacgucaccguggcgcacaccggccagcacgaccuggugaucccgcccaacggguacuuccgguucgacagcugggucaaccaguucuacacgcuggcccccaugggcaacgggaccggccgccggcgcgcccucuga

SEQ ID NO: 10871 - RNA, 1623 nt, Artificial Sequence
  derived and/or modified sequence opt1 from major_capsid_protein__Norovirus__AFJ04709
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucacggugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggggccgccgggcccuguga

SEQ ID NO: 10872 - RNA, 1623 nt, Artificial Sequence
  derived and/or modified sequence opt1 from major_capsid_protein__Norovirus__AFP89593
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacagcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggggaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggcgccuucgugguccagccccagaacgggcgcugcaccaccgacggcgugcuccuggggaccacgcagcucucccccgucaacaucugcaccuuccggggcgacgugacccacaucgccggcacccacaacuacacgaugaaccuggccagccagaacuggaacaacuacgacccgaccgaggagauccccgcgccccuggggacccccgacuucgugggccgcauccaggggaugcucacccagacgacccggggcgacggguccacccgcggccacaaggccaccgucagcacgggcgacgugcacuucaccccgaagcugggguccauccaguucaacaccgacaccaacaacgacuucgagacgggccagaacaccaaguucacccccgugggggucauccaggacggcaacgggacccaccagaacgagccccagcagugggugcugcccagcuacagcggccggacgggccacaacgugcaccucgccccggccgucgcccccaccuuccccggggagcagcugcuguucuuccgcuccaccaugcccggcugcagcggguacccgaacaugaaccucgacugccugcugccccaggagugggugcagcacuucuaccaggaggccgcgcccgcccaguccgacguggcccuccugcgguucgucaaccccgacaccggccgcgugcuguucgagugcaagcuccacaagagcggguacgugaccgucgcccacacgggccagcacgaccuggugaucccgcccaacggcuacuuccgguucgacuccugggugaaccaguucuacacccuggcgcccauggggaacggcaccgggcgccggcgcguccucuga

SEQ ID NO: 10873 - RNA, 1623 nt, Artificial Sequence
  derived and/or modified sequence opt1 from major_capsid_protein__Norovirus__AFU55686
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgaggccgggcagaacacgaaguucacccccgacggcgugguccaggacgggaacggcacccaccagaacgagccccagcagugggugcugcccuccuacagcggccggaccgggcacaacgugcaccucgccccggccaucgcccccacguuccccggcgagcagcugcuguucuuccgcagcaccaugcccgggugcuccggcuacccgaacaugaaccucgacugccugcugccccaggaguggguccagcacuucuaccaggaggcggcccccgcccagagcgacguggcccuccugcgguucgugaaccccgacaccgggcgcguccuguucgagugcaagcuccacaaguccggcuacgugaccguggcgcacaccggccagcacgaccuggucaucccgcccaacggguacuuccgguucgacagcugggugaaccaguucuacacgcuggcccccaugggcaacgggaccggccgccggcgcgcccucuga

SEQ ID NO: 10874 - RNA, 1623 nt, Artificial Sequence
  derived and/or modified sequence opt1 from major_capsid_protein__Norovirus__AFU55689
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcugcuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccugggggcccccgacuucgugggcaagauccaggggguccucacccagaccacgcgcggcgacgggagcacccggggccacaaggccaccguguccaccggcagcgugcacuucacgccgaagcuggggagcguccaguucuccaccgacaccagcaacgaccuggagaccggccagaacacgcgcuucacccccgugggggugguccaggacggcuccaccacccaccagaacgagccccagcagugggugcuccccaacuacagcgggcgggacucccacaacgugcaccuggccccggccgucgcccccacguuccccggcgagcagcuccucuucuuccgcagcaccaugcccggcugcuccggguacccgaacaugaaccuggacugccugcucccccaggagugggugcagcacuucuaccaggagagcgcgcccgcccaguccgacguggcccugcugcgguucgucaaccccgacaccggccgcguccucuucgagugcaagcugcacaagagcggguacgugaccguggcccacaccggccagcacgaccuggugaucccgcccaacggguacuuccgguucgacuccugggugaaccaguucuacacgcucgcgcccaugggcaacggcgccgggcgccggcgcgcccuguga

SEQ ID NO: 10875 - RNA, 1623 nt, Artificial Sequence
  derived and/or modified sequence opt1 from major_capsid_protein__Norovirus__AFU55692
augaagauggccagcaacgacgccacccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagccgggcuacgugaccgucgcccacacggggcagcacgaccuggugaucccgcccaacggcuacuuccgcuucgacagcugggugaaccaguucuacacccuggcccccauggggaacggcgcgggccggcgccgcgcccucuga

SEQ ID NO: 10876 - RNA, 1623 nt, Artificial Sequence; identical to SEQ ID NO: 9305
  derived and/or modified sequence opt1 from major_capsid_protein__Norovirus__AFU55695

SEQ ID NO: 10877 - RNA, 1623 nt, Artificial Sequence
  derived and/or modified sequence opt1 from major_capsid_protein__Norovirus__AFU55698
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugggggccaacaacgcgggcgacgacguguucaccguguccugccggguccugacccgcccgagccccgacuucgacuucaucuuccucgugccgcccaccguggagucccggacgaagcccuucagcguccccauccugaccguggaggagaugaccaacucccgcuuccccaucccccuggagaagcuguucaccggcccgagcuccgccuucgugguccagccccagaacgggcggugcacgaccgacggcgugcuccuggggaccacccagcucagccccgucaacaucugcacguuccgcggcgacgugacccacaucgccggcacccaggaguacaccaugaaccuggccucccagaacuggaacaacuacgacccgacggaggagauccccgcgccccuggggacccccgacuucgugggcaagauccaggggguccucacccagaccacgcggcgcgacggcagcacccgggggcacaaggccaccgugagcaccggcuccgugcacuucacgccgaagcugggccgcauccaguucagcaccgacaccuccaacgacuucgagaccgggcagaacacgcgguucacccccgucggcguggugcaggacgggagcaccacccaccagaacgagccccagcaguggguccugcccaacuacuccggccgcgacagccacaacgugcaccucgccccggccguggcccccuccuuccccggggagcagcugcuguucuuccggagcacgaugcccggcugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccauggggaacggcacgggccggcgccgcgcccucuga

SEQ ID NO: 10878 - RNA, 1623 nt, Artificial Sequence; identical to SEQ ID NO: 9855
  derived and/or modified sequence opt1 from major_capsid_protein__Norovirus__AFU55701

SEQ ID NO: 10879 - RNA, 1623 nt, Artificial Sequence; identical to SEQ ID NO: 9944
  derived and/or modified sequence opt1 from major_capsid_protein__Norovirus__AFU55704

SEQ ID NO: 10880 - RNA, 1623 nt, Artificial Sequence
  derived and/or modified sequence opt1 from major_capsid_protein__Norovirus__AFU55707
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccgagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 10881 - RNA, 1623 nt, Artificial Sequence; identical to SEQ ID NO: 9351
  derived and/or modified sequence opt1 from major_capsid_protein__Norovirus__AFU55710

SEQ ID NO: 10882 - RNA, 1623 nt, Artificial Sequence
  derived and/or modified sequence opt1 from major_capsid_protein__Norovirus__AFU55713
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggccacccagaacuggaacagcuacgacccgaccgaggagauccccgcgccccuggggacccccgacuucgugggcaagauccaggggguccucacgcagaccacccgggccgacggcuccacccgcgggcacaaggccacgguguacaccggcagcgccgacuucgccccgaagcugggccgggugcaguucgccaccgacaccgacaacgacuucgacgccaaccagaacacgaaguucacccccgucggggugauccaggacggcgacaccgcgcaccgcaacgagccccagcagugggugcugcccagcuacuccgggcggaacagccacaacguccaccucgccccggccguggcccccaccuuccccggcgagcagcugcuguucuuccgcuccacgaugcccgggugcagcggcuacccgaacauggaccucgacugccugcugccccaggagugggugcaguacuucuaccaggaggcggcccccgcccaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggacgggccgccgccgggcccucuga

SEQ ID NO: 10883 - RNA, 1623 nt, Artificial Sequence
  derived and/or modified sequence opt1 from major_capsid_protein__Norovirus__AFU55716
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccugaucaucccgcccaacggguacuuccgguucgacagcugggucaaccaguucuacacccucgcccccaugggcaacggcacggggcgccggcgcgcccuguga

SEQ ID NO: 10884 - RNA, 1623 nt, Artificial Sequence; identical to SEQ ID NO: 9927
  derived and/or modified sequence opt1 from major_capsid_protein__Norovirus__AFU55719

SEQ ID NO: 10885 - RNA, 1623 nt, Artificial Sequence; identical to SEQ ID NO: 8842
  derived and/or modified sequence opt1 from major_capsid_protein__Norovirus__AFU55722

SEQ ID NO: 10886 - RNA, 1623 nt, Artificial Sequence
  derived and/or modified sequence opt1 from major_capsid_protein__Norovirus__AFU55725
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccacguucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggcgagccagaacuggaacagcuacgacccgaccgaggagauccccgcgccccuggggacccccgacuucgugggcaagauccaggggguccucacccagacgacccggaccgacggcuccacccgcgggcacaaggccacgguguacaccggcagcgccgaguucuccccgaagcugggccgggugcaguucgccaccgacaccgacaacgacuucgacgccaaccagaacacgaaguucacccccgucggggugauccaggacggcgggaccacccaccgcaacgagccccagcagugggugcugcccagcuacuccggccggaacacgcacaacguccaccucgccccggccguggcccccaccuuccccggggagcagcugcuguucuuccgcagcaccaugcccggcugcuccggcuacccgaacauggaccucgacugccugcugccccaggagugggugcagcacuucuaccaggaggccgcgcccgcccagagcgacgucgcccuccugcgguucgugaaccccgacaccgggcgcgugcuguucgagugcaagcuccacaaguccggcuacgucaccguggcccacacggggcagcacgaccuggugaucccgcccaacggcuacuuccgguucgacagcugggucaaccaguucuacacccuggcgcccauggggaacggcaccggccgccgccgggcccucuga

SEQ ID NO: 10887 - RNA, 1623 nt, Artificial Sequence
  derived and/or modified sequence opt1 from major_capsid_protein__Norovirus__AFU55728
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccacaacuacaccaugaaccuggccucccagaacuggaacagcuacgaccccaccgaggagauccccgcgccccuggggacgccggacuucgucggcaagauccagggggugcucacccagaccacccgcacgaacggcagcacccgggggcacaaggccaccguguacaccggcuccgccgacuucagccccaagcugggccgcguccaguucgccacggacaccaacaacgacuucgagaccaaccagaacaccaaguucacgcccgugggggugauccaggacggcuccaccacgccccggaacgagccgcagcaguggguccugcccagcuacuccgggcgcaacacccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacgcuggcccccaugggcaacgggaccggccggcgccgcgcccucuga

SEQ ID NO: 10888 - RNA, 1623 nt, Artificial Sequence
  derived and/or modified sequence opt1 from major_capsid_protein__Norovirus__AFU55731
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccacaacuacaccaugaaccuggccucccagaacuggaacagcuacgaccccaccgaggagguccccgcgccccuggggacgccggacuucgugggcaagauccagggggugcucacccagaccacccgcacgaacggcagcacccgggggcacaaggccaccgucuacaccggcuccgccgacuucagccccaagcugggccgcgugcaguucgccacggacaccaacaacgacuucgagaccaaccagaacaccaaguucacgcccgugggggucauccaggacggcuccaccacgccccggaacgagccgcagcagugggugcugcccagcuacuccgggcgcaacacccacaacgugcaccucgcccccgccgucgcccccaccuucccgggcgagcagcugcuguucuuccggagcaccaugcccgggugcuccggcuaccccaacauggaccucgacugccugcugccccaggagugggugcaguacuucuaccaggaggcggccccggcccagagcgacguggcccuccugcgcuucgucaaccccgacaccggccgggugcuguucgagugcaagcuccacaaguccggguacgugaccgucgcgcacaccggccagcacgaccuggugaucccgcccaacggguacuuccgcuucgacagcugggugaaccaguucuacacgcuggcccccaugggcaacgggaccggccggcgccgcgcccucuga

SEQ ID NO: 10889 - RNA, 1623 nt, Artificial Sequence; identical to SEQ ID NO: 8882
  derived and/or modified sequence opt1 from major_capsid_protein__Norovirus__AFU55734

SEQ ID NO: 10890 - RNA, 1623 nt, Artificial Sequence; identical to SEQ ID NO: 8882
  derived and/or modified sequence opt1 from major_capsid_protein__Norovirus__AFU55737

SEQ ID NO: 10891 - RNA, 1623 nt, Artificial Sequence
  derived and/or modified sequence opt1 from major_capsid_protein__Norovirus__AFU92659
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugauccccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgcguucgugguccagccccagaacgggcgcugcaccaccgacggcgugcuccuggggaccacgcagcucucccccgucaacaucugcaccuuccggggcgacgugacccacaucgccggcacccagagcuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccgugagcacgggcuccgugcacuucaccccgaagcuggggagcguccaguucuccaccgacaccagcaacgacuucgagacgggccagaacacccgcuucacccccgugggggugguccaggacggcuccaccacgcaccagaacgagccccagcagugggugcugcccaacuacagcgggcgggacucccacaacgugcaccucgccccggccgucgcccccaccuuccccggcgagcagcugcuguucuuccgcagcaccaugcccggcugcuccggguacccgaacaugaaccucgacugccugcugccccaggagugggugcagcacuucuaccaggagagcgcccccgcccaguccgacguggcgcuccugcgguucgucaaccccgacaccggccgcgugcuguucgagugcaagcuccacaagagcggguacgugaccgucgcccacacgggccagcacgaccuggugaucccgcccaacggguacuuccgguucgacuccugggugaaccaguucuacacccuggcccccaugggcaacggcgccgggcgccggcgcgcgcucuga

SEQ ID NO: 10892 - RNA, 1623 nt, Artificial Sequence
  derived and/or modified sequence opt1 from major_capsid_protein__Norovirus__AFU92660
augaagauggccagcaacgacgcccaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcagacgauccucgccgggaacgccuucaccgcgggcaagaucaucuucgccgccgucccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgaccccacgaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucaccgugcccauccugaccgucgaggagaugacgaacagccgguuccccaucccccuggagaagcuguucaccggcccguccagcgccuucguggugcagccccagaacgggcgcugcaccaccgacggcguccuccuggggacgacccagcucucccccgugaacaucugcaccuuccggggcgacgucacccacaucgccggcacgcacaacuacaccaugaaccuggccagccagaacuggaacaacuacgacccgaccgaggagauccccgcgccccuggggacccccgacuucgugggccgcauccaggggaugcucacgcagaccacccggggcgacggguccacccgcggccacaaggccacggugagcaccggcgacguccacuucaccccgaagcugggguccauccaguucaacaccgacacgaacaacgacuucgagaccggccagaacaccaaguucacccccgugggggugguccaggacggcaacgggacgcaccagaacgagccccagcagugggugcugcccagcuacagcggccggaccggccacaacgugcaccucgccccggccgucgcccccaccuuccccggggagcagcugcuguucuuccgcuccaccaugcccggcugcagcggguacccgaacaugaaccucgacugccugcugccccaggagugggugcagcacuucuaccaggaggccgcgcccgcccaguccgacguggcccuccugcgguucgucaaccccgacaccggccgcgugcuguucgagugcaagcuccacaagagcggguacgugacggucgcccacaccggccagcacgaccuggugaucccgcccaacggcuacuuccgguucgacuccugggugaaccaguucuacacccuggcgcccauggggaacggcaccgggcgccggcgcgcccucuga

SEQ ID NO: 10893 - RNA, 1623 nt, Artificial Sequence
  derived and/or modified sequence opt1 from major_capsid_protein__Norovirus__AFU92661
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugccacgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgccuucgugguccagccccagaacgggcgcugcaccaccgacggcgugcugcuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggccgcauccaggggguccucacccagacgacccggcgcgacggcuccacccgggggcacaaggccacccugagcacgggcuccgugcacuucaccccgaagcugggcagcgugcaguucagcaccgacaccuccaacgacuucgagacggggcagaacacccgcuucacccccgucggcguggugcaggacgggagcaccacgcaccagaacgagccccagcaguggguccuccccaacuacuccggccgggacagccacaacgugcaccuggccccggccguggcccccaccuuccccggggagcagcuccucuucuuccgcuccaccaugcccggcugcagcggcuacccgaacaugaaccuggacugccugcucccccaggaguggguccagcacuucuaccaggaguccgcccccgcgcagagcgacguggcccugcugcgguucgugaaccccgacaccgggcgcguccucuucgagugcaagcugcacaaguccggcuacgugaccguggcccacacggggcagcacgaccuggucaucccgcccaacggcuacuuccgguucgacagcugggugaaccaguucuacacccucgcccccauggggaacggcgcgggccgccgccgggcccuguga

SEQ ID NO: 10894 - RNA, 1623 nt, Artificial Sequence
  derived and/or modified sequence opt1 from major_capsid_protein__Norovirus__AFU92662
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccuguggcacgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgccuucgugguccagccccagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggcaagauccaggggguccucacccagacgacccgccgggacggcuccacccgcgggcacaaggccaccgugagcacgggcuccauccacuucaccccgaagcugggcagcgugcaguucagcaccgacaccuccaacgacuucgagacggggcagaacacccgguucacccccgucggcguggugcaggacgggagcaccacgcaccagaacgagccccagcaguggguccugcccaacuacuccggccgcgacagccacaacgugcaccucgccccggccguggcccccaccuuccccggggagcagcugcuguucuuccgguccaccaugcccggcugcagcggcuacccgaacaugaaccucgacugccugcugccccaggaguggguccagcacuucuaccaggaguccgcccccgcgcagagcgacguggcccuccugcgcuucgugaaccccgacaccgggcggguccuguucgagugcaagcuccacaaguccggcuacgugaccguggcccacacggggcagcacgaccuggucaucccgcccaacggcuacuuccgcuucgacagcugggugaaccaguucuacacccuggcccccauggggaacggcgcgggccggcgccgcgcccucuga

SEQ ID NO: 10895 - RNA, 1623 nt, Artificial Sequence
  derived and/or modified sequence opt1 from major_capsid_protein__Norovirus__AFU92663
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgcguucgugguccagccccagaacgggcgcugcaccaccgacggcgugcuccuggggaccacgcagcucucccccgucaacaucugcaccuuccggggcaacgugaccaacaucgccggcagccagaccuacacgaugaaccuggccucccagaacuggaacaacuacgacccgaccgaggagauccccgcgccccuggggacccccgacuucgugggccgcauccaggggguccucacccagacgacccggggcgacgggagcacccgcggccacaaggccaccgugagcacgggcuccgccuacuucaccccgaagcuggggagcgugcaguucuccaccgacaccagcacggacuucgagaccggccagaacacccgguucacccccgucgggguggugcaggacggcuccacgacccacaagaacgagccccagcaguggguccugcccagcuacuccgggcgcgacagccacaacgugcaccucgccccggccguggcccccaccuuccccggcgagcagauccuguucuuccgguccaccaugcccggcugcagcggguacccgaacauggaccuggacugccuccugccccaggaguggguccagcacuucuaccaggaguccgcccccgcgcagagcgacguggcccugcuccgcuucgugaaccccgacaccggccggguccuguucgagugcaagcugcacaaguccggguacgugacgguggcccacaccggccagcacgaccucgucaucccgcccaacggguacuuccgcuucgacagcugggugaaccaguucuacacccuggcccccaugggcaacggcgcggggcggcgccgcgcccuguga

SEQ ID NO: 10896 - RNA, 1623 nt, Artificial Sequence
  derived and/or modified sequence opt1 from major_capsid_protein__Norovirus__AFU92664
augaagauggccagcaacgacgccaaccccuccgacggcagcgcggcccaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10897 - RNA, 1623 nt, Artificial Sequence
  derived and/or modified sequence opt1 from major_capsid_protein__Norovirus__AFU92666
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccucccucgacuucgacuucaucuuccuggugccgcccaccguggagagccgcaccaagcccuucacgguccccauccugaccguggaggagaugaccaacucccgguucccgaucccccucgagaagcuguucaccggccccagcggggccuucgugguccagccccagaacggccgcugcacgaccgacggggugcugcucggcaccacccagcuguccccggucaacaucugcacguuccggggcgacgugacccacaucgccgggagccgcaacuacaccaugaaccuggccucccucaacuggaacaacuacgaccccaccgaggagacgcccgcgccgcugggcacccccgacuucguggggaagauccagggcguccugacccagaccacgaagggggacggcagcacccggggccacaaggccaccguguacaccggguccgcccccuucacgcccaagcucggcagcgugcaguucagcaccgacaccgagaacgacuucgagacccaccagaacacgaaguucaccccggucggggugauccaggacggcgggaccacccaccgcaacgagccccagcagugggugcugcccuccuacagcggccggaacguccacaacgugcaccuggcccccgccguggcgccgacguuccccggcgagcagcuccuguucuuccgcuccaccaugcccgggugcagcggcuaccccaacauggaccuggacugccuccugccgcaggaguggguccagcacuucuaccaggaggccgcccccgcccaguccgacguggcgcugcuccgguucgugaaccccgacaccgggcgcguccuguucgagugcaagcugcacaagagcggcuacgugaccguggcccacaccgggcagcacgaccucgucaucccgcccaacggcuacuuccgguucgacuccugggugaaccaguucuacacgcuggcccccaugggcaacgggaccggccgccggcgcgcccuguga

SEQ ID NO: 10898 - RNA, 1623 nt, Artificial Sequence
  derived and/or modified sequence opt1 from major_capsid_protein__Norovirus__AFU92667
augaagauggccagcaacgacgccacccccuccgacggcguggcggcccaccuggucccggaggugaacaacgaggugauggcccucgagcccgucgugggggccgccaucgcggcccccguggccggccagcagaacgucaucgaccccuggauccgcaacaacuucgugcaggcccccgggggcgaguucaccgugagcccccggaacgcgcccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgaggacguguucaccgucuccugccgcgugcugacccggcccagcccggacuucgacuucaucuuccucgugccgcccaccgucgagucccgcacgaagcccuucaccgugcccauccugaccguggaggagaugaccaacagccgguuccccaucccccuggagaagcuguucacgggccccuccggggccuucgucgugcagccgcagaacggccgcugcaccaccgacgggguccugcugggcaccacgcagcucagccccgugaacaucugcaccuuccggggcgacgugacccacaucgccgggucccgcaacuacaccaugaaccuggccagccugaacuggaacaacuacgaccccacggaggagaucccggcgccccucggcacccccgacuucgucgggaagauccagggcgugcugacccagaccacgaagggggacggcuccacccggggccacaaggccaccguguacaccgggagcgcccccuucacgccgaagcugggcuccguccaguucagcaccgacaccgagaacgacuucgagacccaccagaacacgaaguucacccccgugggggugauccaggacggcgggaccacccaccgcaacgagccccagcaguggguccuccccagcuacuccggccggaacgugcacaacgugcaccuggccccggccgucgcgcccacguuccccggcgagcagcuccucuucuuccgcagcaccaugcccgggugcuccggcuacccgaacauggaccuggacugccugcucccccaggagugggugcagcacuucuaccaggaggccgcccccgcccagagcgacguggcgcugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacgcucgcccccaugggcaacgggaccggccgccggcgcgcccuguga

SEQ ID NO: 10899 - RNA, 1623 nt, Artificial Sequence
  derived and/or modified sequence opt1 from major_capsid_protein__Norovirus__AFU92668
augaagauggccagcaacgacgugacccccuccgacggcagcgccgcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgaggacguguucaccgucagcugccgcgugcugacccggcccuccccggacuucgacuucaucuuccucgugccgcccaccgucgagagccgcacgaagcccuucaccgugcccauccugaccguggaggagaugaccaacucccgguuccccaucccccuggagaagcuguucacgggccccagcggggccuucgucgugcagccgcagaacggccgcugcaccaccgacgggguccugcugggcaccacgcagcucucccccgugaacaucugcaccuuccggggcgacgugacccacaucgccgggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgagacccaccagaacacgaaguucacccccgugggggugauccaggacggcgggaccacccaccgcaacgagccccagcaguggguccuccccuccuacagcggccggaacgugcacaacgugcaccuggccccggccgucgcccccacguuccccggcgagcagcuccucuucuuccgcuccaccaugcccgggugcagcggcuacccgaacauggaccuggacugccugcucccccaggagugggugcagcacuucuaccaggaggcggcccccgcccaguccgacguggcccugcugcgguucgucaaccccgacaccgggcgcguccucuucgagugcaagcugcacaagagcggcuacgugaccguggcgcacaccgggcagcacgaccuggugaucccgcccaacggcuacuuccgguucgacuccugggugaaccaguucuacacgcucgcccccaugggcaacgggaccggccgccggcgcgcccuguga

SEQ ID NO: 10900 - RNA, 1623 nt, Artificial Sequence; identical to SEQ ID NO: 9910
  derived and/or modified sequence opt1 from major_capsid_protein__Norovirus__AFU92669

SEQ ID NO: 10901 - RNA, 1623 nt, Artificial Sequence
  derived and/or modified sequence opt1 from major_capsid_protein__Norovirus__AFU92670
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggcgcgcgccccugggcccggaccucaaccccuaccugucccaccuggcccggauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccaguccaacgacagcaccaucaagcugaucgccaugcucuacacgccccugcgcgcgaacaacgccggcgaggacguguucaccguguccugccggguccugacccgccccagcccggacuucgacuucaucuuccucgugccgcccaccguggagucccggaccaagcccuucacgguccccauccugaccguggaggagaugaccaacagccgcuuccccaucccccuggagaagcuguucaccggccccuccagcgccuucgugguccagccgcagaacgggcggugcacgaccgacggcgugcugcuggggaccacccagcucucccccgucaacaucugcacguuccgcggcgacgugacccacaucgccggcagccggaacuacaccaugaaccuggccucccugaacuggaacaacuacgaccccaccgaggaggugccggcgccccucgggacgcccgacuucgucggcaagauccagggggugcugacccagaccaccaagggcgacgggagcacgcgcggccacaaggccaccguguacaccggcuccgcccccuucaccccgaagcuggggagcguccaguucagcacggacaccgagaacgacuucgagacccaccagaacaccaaguucacgcccgugggcgugauccaggacggguccaccacccaccggaacgagccccagcaguggguccuccccagcuacuccggccgcaacgugcacaacgugcaccuggccccggccgucgcgcccaccuuccccggggagcagcuccucuucuuccggagcacgaugcccggcugcuccggcuacccgaacauggaccuggacugccugcucccccaggagugggugcagcacuucuaccaggaggccgcccccgcccagagcgacguggcgcugcugcgcuucgucaaccccgacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccggcgccgcgcccuguga

SEQ ID NO: 10902 - RNA, 1623 nt, Artificial Sequence
  derived and/or modified sequence opt1 from major_capsid_protein__Norovirus__AFU92671
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcggcgcgacggcuccacccgggggcacaaggccaccgugagcaccggcagcgugcacuucacgccgaagcugggccgcauccaguucuccaccgacaccagcaacgacuucgagaccgggcagaacacgcgguucacccccgucggcguggugcaggacggguccaccacccaccagaacgagccccagcaguggguccugcccgacuacagcggccgcgacucccacaacgugcaccucgccccggccguggcccccagcuuccccggggagcagcugcuguucuuccgguccacgaugcccggcugcagcggcuacccgaacaugaaccucgacugccugcugccccaggaguggguccagcacuucuaccaggaggccgcgcccgcccaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcgcccauggggaacggcacgggccgccggcgcgcccucuga

SEQ ID NO: 10903 - RNA, 1623 nt, Artificial Sequence
  derived and/or modified sequence opt1 from major_capsid_protein__Norovirus__AFU92672
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagacgccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 10904 - RNA, 1623 nt, Artificial Sequence
  derived and/or modified sequence opt1 from major_capsid_protein__Norovirus__AFU92673
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgccgugcagccgcagaacggccgcugcacgaccgacgggguccugcugggcaccacccagcucucccccgugaacaucugcacguuccggggcgacgucacccacaucgccgggagccgcaacuacaccaugaaccuggcgucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgagacccaccagaacaccaaguucacgcccgugggggucauccaggacggcgggaccacccaccgcaacgagccccagcagugggugcuccccuccuacagcggccggaacgugcacaacguccaccuggccccggccguggcccccaccuuccccggcgagcagcuccucuucuuccgcuccacgaugcccgggugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgccaccguggcccacaccgggcagcacgaccuggugaucccgcccaacggcuacuuccgguucgacuccugggugaaccaguucuacacccucgcccccaugggcaacgggacgggccgccggcgcgcgcuguga

SEQ ID NO: 10905 - RNA, 1623 nt, Artificial Sequence
  derived and/or modified sequence opt1 from major_capsid_protein__Norovirus__AFU92674
augaagauggccagcaacgacgcccaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaccaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 10906 - RNA, 1623 nt, Artificial Sequence
  derived and/or modified sequence opt1 from major_capsid_protein__Norovirus__AFU92676
augaagauggccagcuccgacgcccaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgagccgggacgggagcacccggggccacaaggccaccguguccaccgggagcgugcacuucacgccgaagcugggccgcguccaguucuccaccgacaccagcaacgacuucgagaccggccagaacacgcgguucacccccgugggggugguccaggacggcuccaccacccaccagaacgagccccagcagugggugcugcccaacuacagcgggcgcgacucccacaacgugcaccucgccccggccgucgcccccagcuuccccggcgagcagcugcuguucuuccgguccacgaugcccgggugcagcggcuacccgaacaugaaccucgacugccugcugccccaggagugggugcagcacuucuaccaggaggccgcgcccgcccaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcgcccaugggcaacgggacgggccggcgccgcgcccucuga

SEQ ID NO: 10907 - RNA, 1623 nt, Artificial Sequence
  derived and/or modified sequence opt1 from major_capsid_protein__Norovirus__AFU92677
augaagauggccagcaacgacgcccaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 10908 - RNA, 1623 nt, Artificial Sequence
  derived and/or modified sequence opt1 from major_capsid_protein__Norovirus__AFU92678
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguacgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 10909 - RNA, 1623 nt, Artificial Sequence
  derived and/or modified sequence opt1 from major_capsid_protein__Norovirus__AFU92679
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggaguucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 10910 - RNA, 1623 nt, Artificial Sequence; identical to SEQ ID NO: 9910
  derived and/or modified sequence opt1 from major_capsid_protein__Norovirus__AFU92680

SEQ ID NO: 10911 - RNA, 1623 nt, Artificial Sequence; identical to SEQ ID NO: 9305
  derived and/or modified sequence opt1 from major_capsid_protein__Norovirus__AFU92681

SEQ ID NO: 10912 - RNA, 1623 nt, Artificial Sequence; identical to SEQ ID NO: 9305
  derived and/or modified sequence opt1 from major_capsid_protein__Norovirus__AFU92682

SEQ ID NO: 10913 - RNA, 1623 nt, Artificial Sequence; identical to SEQ ID NO: 9989
  derived and/or modified sequence opt1 from major_capsid_protein__Norovirus__AFU92684

SEQ ID NO: 10914 - RNA, 1623 nt, Artificial Sequence
  derived and/or modified sequence opt1 from major_capsid_protein__Norovirus__AFU92685
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacguggcccacaucgccggcacccaggaguacaccaugaaccuggccagccagaacuggaacaacuacgacccgaccgaggagauccccgcgccccuggggacgcccgacuucgugggcaagauccaggggguccucacccagaccacccggcgcgacggcuccacgcgggggcacaaggccaccgugagcaccggcagcgugcacuucaccccgaagcugggccgcauccaguucuccacggacaccagcaacgacuucgagaccgggcagaacacccgguucacgcccgucggcguggugcaggacgggggcaccacccaccagaacgagccccagcaguggguccugcccgacuacuccgggcgcgacagccacaacgugcaccucgccccggccguggcccccuccuuccccggcgagcagcugcuguucuuccggagcaccaugcccggcugcuccggguacccgaacaugaaccucgacugccugcugccccaggaguggguccagcacuucuaccaggaggcggcccccgcccagagcgacguggcccuccugcgcuucgugaaccccgacacgggccggguccuguucgagugcaagcuccacaaguccggguacgugaccguggcgcacaccggccagcacgaccuggucaucccgcccaacggguacuuccgcuucgacagcugggugaaccaguucuacacccuggcccccaugggcaacggcaccgggcgccggcgcgcccucuga

SEQ ID NO: 10915 - RNA, 1623 nt, Artificial Sequence
  derived and/or modified sequence opt1 from major_capsid_protein__Norovirus__AFU92686
augaagauggccagcaacgacgcccaccccuccgacggcagcgcggccacccuggugccgaaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgagcuccacgugcugcuggccgggaacgccuucacggccggcaagaucaucaucgccgccgucccgcccaacuucccgaccgaggggcucagccccucccaggugaccauguucccccacaucaucguggacguccggcagcuggagcccgugcugaucccgcuccccgacgugcgcaacaacuucuaccacuacaaccagagcaacgacuccaccaucaagcugaucgccaugcuguacacgccccuccgggcgaacaacgccggcgaggacgucuucaccgugagcugccgcgugcugacccggcccuccccggacuucgacuucaucuuccuggucccgcccaccguggagagccgcacgaagcccuucaccgugcccauccucaccgucgaggagaugaccaacucccgguuccccaucccccuggagaagcuguucacgggccccagcggggccuucguggugcagccgcagaacggccgcugcaccaccgacgggguccuccugggcaccacgcagcugucccccgugaacaucugcaucuuccggggcgacgucacccacaucgccgggagccgcaacuacaccaugaaccucgccgcgcugaacuggaacaacuacgaccccaccgaggagaucccggcgccccugggcacgcccgacuucguggggaagauccagggcgugcucacccagaccaccaagggggacggcuccacgcggggccacaaggccaccgucuacaccgggagcgccgacuucacccccaagcugggcuccgugcaguucagcacggacaccgagaacgacuucgagacccaccagaacaccaaguucacgccggugggggucauccaggacggcagcaccacccaccgcaacgagccccagcagugggugcugcccuccuacagcgggcggaacgugcacaacguccaccucgcccccgccguggccccgaccuuccccggcgagcagcugcuguucuuccgcuccacgaugcccggcugcagcggguaccccaacauggaccucgacugccugcugccgcaggagugggugcagcacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacggcacggggcgccggcgcgcccucuga

SEQ ID NO: 10916 - RNA, 1623 nt, Artificial Sequence
  derived and/or modified sequence opt1 from major_capsid_protein__Norovirus__AFU92687
augaagauggccagcaacgaccccaaccccuccgacggcagcgccgcgaaccuggugcccgaggucaacaacgaggugauggcccucgagcccguggucggggccgccaucgccgcgcccguggccggccagcagaacgugaucgacccguggauccgcaacaacuucguccaggcccccgggggcgaguucaccgugagcccccggaacgcccccggggagauccugugguccgcgccgcugggccccgaccucaaccccuaccugucccaccuggcccgcauguacaacggcuacgccgggggcuucgaggugcaggucauccucgccgggaacgccuucaccgcgggcaagaucaucuucgccgccgugcccccgaacuuccccacggaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggggccuucgugguccagccccagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgacccgacggaggagauccccgcgccccucggcacccccgacuucguggggaagauccagggcguccugacccagaccacgaagggggacggcuccacccggggccacaaggccaccguguacaccgggagcgccccguucacgcccaagcugggcuccgugcaguucagcaccgacaccgagaacgacuucgagacccaccagaacacgaaguucacccccgucggggugauccaggacggcgggaccacccaccgcaacgagccccagcagugggugcucccgagcuacuccggccggaacguccacaacgugcaccuggcccccgccguggcccccacguuccccggcgagcagcuccucuucuuccgcagcaccaugccggggugcuccggcuaccccaacauggaccuggacugccugcucccccaggaguggguccagcacuucuaccaggaggcggcccccgcccagagcgacguggcccugaugcgguucgugaacccggacaccgggcgcguccuguucgagugcaagcuccacaaguccggcuacgugaccguggcgcacaccgggcagcacgaccuggucaucccgcccaacggcuacuuccgguucgacagcugggugaaccaguucuacacgcuggcccccaugggcaacgggaccggccgccggcgcgcccucuga

SEQ ID NO: 10917 - RNA, 1623 nt, Artificial Sequence
  derived and/or modified sequence opt1 from major_capsid_protein__Norovirus__AFU92688
augaagauggccagcaacgacgcccaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgaccccacggaggagaucccggcgccccucggcccgcccgacuucguggggaagauccagggcguccugacccagaccaccaagggggacggcuccacgcggggccacaaggccaccguguacaccgggagcgcccccuucacccccaagcugggcuccgugcaguucagcacggacaccgagaacgacuucgagacccaccagaacaccaaguucacgcccgucggggugauccaggacggcgggaccacccaccgcaacgagccccagcagugggugcucccgagcuacuccggccggaacguccacaacgugcaccuggcccccgccguggcgcccaccuuccccggcgagcagcuccucuucuuccgcagcacgaugccggggugcuccggcuaccccaacauggaccuggacugccugcucccccaggaguggguccagcacuucuaccaggaggccgcccccgcccagagcgacguggcgcugaugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccaugggcaacgggacgggccgccggcgcgcccucuga

SEQ ID NO: 10918 - RNA, 1623 nt, Artificial Sequence; identical to SEQ ID NO: 9332
  derived and/or modified sequence opt1 from major_capsid_protein__Norovirus__AFU92689

SEQ ID NO: 10919 - RNA, 1623 nt, Artificial Sequence; identical to SEQ ID NO: 9332
  derived and/or modified sequence opt1 from major_capsid_protein__Norovirus__AFU92690

SEQ ID NO: 10920 - RNA, 1623 nt, Artificial Sequence; identical to SEQ ID NO: 9332
  derived and/or modified sequence opt1 from major_capsid_protein__Norovirus__AFU92691

SEQ ID NO: 10921 - RNA, 1623 nt, Artificial Sequence; identical to SEQ ID NO: 9989
  derived and/or modified sequence opt1 from major_capsid_protein__Norovirus__AFU92692

SEQ ID NO: 10922 - RNA, 1623 nt, Artificial Sequence
  derived and/or modified sequence opt1 from major_capsid_protein__Norovirus__AFU92693
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10923 - RNA, 1623 nt, Artificial Sequence; identical to SEQ ID NO: 9382
  derived and/or modified sequence opt1 from major_capsid_protein__Norovirus__AFU92694

SEQ ID NO: 10924 - RNA, 1623 nt, Artificial Sequence; identical to SEQ ID NO: 9441
  derived and/or modified sequence opt1 from major_capsid_protein__Norovirus__AFU92695

SEQ ID NO: 10925 - RNA, 1623 nt, Artificial Sequence; identical to SEQ ID NO: 9967
  derived and/or modified sequence opt1 from major_capsid_protein__Norovirus__AFU92696

SEQ ID NO: 10926 - RNA, 1623 nt, Artificial Sequence; identical to SEQ ID NO: 9441
  derived and/or modified sequence opt1 from major_capsid_protein__Norovirus__AFU92697

SEQ ID NO: 10927 - RNA, 1623 nt, Artificial Sequence; identical to SEQ ID NO: 9292
  derived and/or modified sequence opt1 from major_capsid_protein__Norovirus__AFU92698

SEQ ID NO: 10928 - RNA, 1623 nt, Artificial Sequence
  derived and/or modified sequence opt1 from major_capsid_protein__Norovirus__AFU92699
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucauccuggacguccggcagcucgagcccgugcugaucccgcugcccgacgugcgcaacaacuucuaccacuacaaccagagcaacgacuccaccaucaagcucaucgccaugcuguacacgccccugcgggcgaacaacgccggcgaggacgucuucaccgugagcugccgcgugcucacccggcccuccccggacuucgacuucaucuuccuggucccgcccaccguggagagccgcaccaagcccuucacggugcccauccugaccgucgaggagaugaccaacucccgguuccccaucccccucgagaagcuguucaccggccccagcggggccuucguggugcagccgcagaacggccgcugcacgaccgacgggguccugcucggcaccacccagcugucccccgugaacaucugcacguuccggggcgacgucacccacaucgccgggagccgcaacuacaccaugaaccuggccucccucaacuggaacaacuacgaccccaccgaggagaucccggcgccccugggcacgcccgacuucguggggaagauccagggcgugcugacccagaccaccaagggggacggcagcacgcggggccacaaggccaccgucuacaccggguccgcccccuucaccccgaagcucggcagcgugcaguucagcacggacaccgagaacgacuucgagacccaccagaacaccaaguucacgcccgugggggucauccaggacggcuccaccacccgccggaacgagccccagcagugggugcugcccagcuacuccgggcgcaacgcccacaacgugcaccuggccccggcggucgcccccaccuuccccggcgagcagcuccuguucuuccggagcacgaugcccggcugcuccggguacccgaacauggaccuggacugccuccugccccaggagugggugcagcacuucuaccaggaggccgcccccgcgcagagcgacguggcccugcuccgcuucgucaaccccgacaccggccgggugcuguucgagugcaagcugcacaaguccggguacgugaccgucgcccacaccggccagcacgaccucgugaucccgcccaacggguacuuccgcuucgacagcugggugaaccaguucuacacccuggcccccaugggcaacggcacggggcggcgccgcgcccuguga

SEQ ID NO: 10929 - RNA, 1623 nt, Artificial Sequence
  derived and/or modified sequence opt1 from major_capsid_protein__Norovirus__AFU92700
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggccggaacguccagaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10930 - RNA, 1623 nt, Artificial Sequence; identical to SEQ ID NO: 9441
  derived and/or modified sequence opt1 from major_capsid_protein__Norovirus__AFU92701

SEQ ID NO: 10931 - RNA, 1623 nt, Artificial Sequence; identical to SEQ ID NO: 9382
  derived and/or modified sequence opt1 from major_capsid_protein__Norovirus__AFU92702

SEQ ID NO: 10932 - RNA, 1623 nt, Artificial Sequence
  derived and/or modified sequence opt1 from major_capsid_protein__Norovirus__AFU92703
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugcagaacguccaccuggccccggccguggcgcccaccuuccccggggagcagcuccucuucuuccgcuccacgaugcccggcugcagcggcuacccgaacauggaccuggacugccugcucccccaggagugggugcagcacuucuaccaggaggccgcccccgcccaguccgacgucgcgcugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcgcccuguga

SEQ ID NO: 10933 - RNA, 1623 nt, Artificial Sequence
  derived and/or modified sequence opt1 from major_capsid_protein__Norovirus__AFU92704
augaagauggccagcuccgacgccaaccccagcgacggcuccaccgcgcaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 10934 - RNA, 1623 nt, Artificial Sequence; identical to SEQ ID NO: 9292
  derived and/or modified sequence opt1 from major_capsid_protein__Norovirus__AFU92705

SEQ ID NO: 10935 - RNA, 1623 nt, Artificial Sequence; identical to SEQ ID NO: 8882
  derived and/or modified sequence opt1 from major_capsid_protein__Norovirus__AFU92706

SEQ ID NO: 10936 - RNA, 1623 nt, Artificial Sequence
  derived and/or modified sequence opt1 from major_capsid_protein__Norovirus__AFU92707
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccgggucgaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 10937 - RNA, 1623 nt, Artificial Sequence
  derived and/or modified sequence opt1 from major_capsid_protein__Norovirus__AFU92708
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaccuuccccggcgagcagcuccucuucuuccgcuccacgaugcccggcugcagcggguaccccaacaugaaccuggacugccugaucccgcaggaguggguccagcacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggcgccgggcgccggcgcgcgcucuga

SEQ ID NO: 10938 - RNA, 1623 nt, Artificial Sequence; identical to SEQ ID NO: 8882
  derived and/or modified sequence opt1 from major_capsid_protein__Norovirus__AFU92709

SEQ ID NO: 10939 - RNA, 1623 nt, Artificial Sequence; identical to SEQ ID NO: 8882
  derived and/or modified sequence opt1 from major_capsid_protein__Norovirus__AFU92710

SEQ ID NO: 10940 - RNA, 1623 nt, Artificial Sequence; identical to SEQ ID NO: 8882
  derived and/or modified sequence opt1 from major_capsid_protein__Norovirus__AFU92711

SEQ ID NO: 10941 - RNA, 1623 nt, Artificial Sequence
  derived and/or modified sequence opt1 from major_capsid_protein__Norovirus__AFU92712
augaagauggccagcaacgacgccaaccccuccgagggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccgggaccauccgcugguccgcgccccugggcccggaccugaaccccuaccucucccaccuggcccggauguacaacggcuacgccgggggcuucgaggugcaggucauccuggccgggaacgccuucacggccggcaagaucaucuucgccgccgugccgcccaacuucccgaccgaggggcucagccccucccaggugaccauguucccccacaucaucgucgacgugcgccagcuggagcccgugcugaucccgcuccccgacguccggaacaacuucuaccacuacaaccagagcaacgacuccaccaucaagcugaucgccaugcuguacacgccccuccgcgcgaacaacgccggcgaggacguguucaccgugagcugccggguccugacccgccccuccccggacuucgacuucaucuuccuggugccgcccaccguggagagccggacgaagcccuucaccguccccauccucaccguggaggagaugaccaacucccgcuucagcaucccccuggagaagcuguucacgggccccuccggggccuucgugguccagccccagaacggccggugcaccaccgacggggugcuccugggcaccacgcagcugagcccggucaacaucugcaccuuccgcggcgacgugacccacaucgccgggucccggaacuacaccaugaaccucgccgcgcugaacuggaacaacuacgaccccacggaggagauccccgccccgcugggcacccccgacuucguggggaagauccagggcguccucacccagaccacgaagggggacggcagcacccgcggccacaaggccaccguguacaccggguccgccgacuucacgcccaagcugggcagcgugcaguucagcaccgacaccgagaacgacuucgagucccaccagaacaccaaguucacgcccgucggggugauccaggacggcagcaccacccaccggaacgagccgcagcagugggugcugcccuccuacagcgggcgcaacguccacaacgugcaccucgcccccgcgguggcccccaccuucccgggcgagcagcugcuguucuuccgguccacgaugcccggcugcagcggguaccccaacauggaccucgacugccugaucccccaggaguggguccagcacuucuaccaggaggccgccccggcgcaguccgacguggcccugcuccgcuucgugaaccccgacaccggccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacggcgccgggcggcgccgcgcgcuguga

SEQ ID NO: 10942 - RNA, 1623 nt, Artificial Sequence
  derived and/or modified sequence opt1 from major_capsid_protein__Norovirus__AFU92713
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguucagcaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacauccccggcagccgcaacuacaccaugaaccuggccagccagaacuggaacuccuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 10943 - RNA, 1623 nt, Artificial Sequence; identical to SEQ ID NO: 8882
  derived and/or modified sequence opt1 from major_capsid_protein__Norovirus__AFU92714

SEQ ID NO: 10944 - RNA, 1623 nt, Artificial Sequence
  derived and/or modified sequence opt1 from major_capsid_protein__Norovirus__AFU92715
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguucuccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 10945 - RNA, 1623 nt, Artificial Sequence
  derived and/or modified sequence opt1 from major_capsid_protein__Norovirus__AFU92717
augaagauggccagcuccgaccccaacccgagcgacggcuccaccgccaaccuggugcccgaggucaacaacgaggugauggcgcucgagcccguggucggggccgccaucgccgcccccguggcgggccagcagaacgugaucgacccguggauccgcaacaacuucguccaggcccccgggggcgaguucaccgugagcccccggaacgcccccggggagauccugugguccgccccgcugggccccgaccucaaccccuaccugagccaccuggcgcgcauguacaacggcuacgccgggggcuucgaggugcaggucauccucgccgggaacgccuucacggccggcaagaucaucuucgcggccgugcccccgaacuuccccaccgaggggcugucccccagccaggugaccauguucccccacaucaucgucgacgugcggcagcuggagccggugcucaucccccugcccgacguccgcaacaacuucuaccacuacaaccaguccaacgacagcaagcugaagcuccggcccaugcuguacaccccgcugcgcgccaacaacgccggcgacgacguguucacgguguccugccggguccucacccgccccagccccgacuucgacuucaucuuccuggugcccccgaccguggagucccggaccaagcccuucagcguccccgugcugacgguggaggagaugaccaacucccgcuuccccaucccgcucgagaagcuguucaccggccccagcuccgccuucgucgugcagccccagaacgggcggugcaccacggacggcguccugcucgggaccacccagcugagcccggugaacaucugcaccuuccgcggcgacgugacgcacauccccggcucccggaacuacaccaugaaccuggcgagccagaacuggaacagcuacgaccccaccgaggagauccccgccccgcucgggacccccgacuucgucggcaagauccagggggugcugacgcagaccacccgcaccaacggcuccacgcgggggcacaaggccaccguguacaccggcagcgccgacuucucccccaagcugggccgcguccaguucgccaccgacacggacaacgacuucgagaccaaccagaacaccaaguucacccccgugggggugauccaggacggcagcacgaccccgcggaacgagccccagcaguggguccuccccuccuacagcgggcgcaacauccacaacgugcaccuggcgcccgccguggccccgaccuuccccggcgagcagcuccuguucuuccgguccaccaugcccgggugcagcggcuaccccaacauggaccuggacugccugcucccgcaggaguggguccaguacuucuaccaggaggccgcccccgcgcaguccgacguggcccugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacgggaccggccgccggcgcgcgcuguga

SEQ ID NO: 10946 - RNA, 1623 nt, Artificial Sequence
  derived and/or modified sequence opt1 from major_capsid_protein__Norovirus__AFU92718
augaagauggccagcaacgacgccaaccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccucgacuucgacuucaucuuccuggugccgcccaccguggagucccgcacgaagcccuucagcguccccgugcugaccguggaggagaugaccaacucccgguuccccaucccccucgagaagcuguucaccggccccagcuccgccuucgucgugcagccgcagaacgggcgcugcacgaccgacggcguccugcucgggaccacccagcugagccccgugaacaucugcacguuccggggcgacgugauccacauccccggcucccgcaacuacaccaugaaccuggccagccagaacuggaacuccuacgacccgaccgaggagauccccgcgccccucgggacccccgacuucgucggcaagauccagggggugcugacgcagaccacccggaccaacggcagcacgcgcgggcacaaggccaccguguacaccggcagcgccgacuucuccccgaagcugggccggguccaguucgccaccgacacggacaacgacuucgagaccaaccagaacaccaaguucacccccgugggggugauccaggacggcagcacgacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggaccggccgccgccgggcccuguga

SEQ ID NO: 10947 - RNA, 1623 nt, Artificial Sequence; identical to SEQ ID NO: 9441
  derived and/or modified sequence opt1 from major_capsid_protein__Norovirus__AFU92719

SEQ ID NO: 10948 - RNA, 1623 nt, Artificial Sequence
  derived and/or modified sequence opt1 from major_capsid_protein__Norovirus__AFU92720
augaagauggccagcuccgacgcccaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 10949 - RNA, 1623 nt, Artificial Sequence
  derived and/or modified sequence opt1 from major_capsid_protein__Norovirus__AFU92721
augaagauggccagcuccgacgcccaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgggcccucuga

SEQ ID NO: 10950 - RNA, 1623 nt, Artificial Sequence
  derived and/or modified sequence opt1 from major_capsid_protein__Norovirus__AFU92722
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucaucguccagccccagaacgggcgcugcacgaccgacggcgugcuccuggggaccacccagcucucccccgucaacaucugcacguuccggggcgacgugacccacaucagcggcucccgcaacuacaccaugaaccuggccagccagaacuggaacagcuacgacccgaccgaggagauccccgcgccccuggggacgcccgacuucgugggcaagauccaggggguccucacccagaccacccggacggacggcuccacccgcgggcacaaggccaccguguacaccggcagcgccgacuucuccccgaagcugggccgggugcaguucgccacggacaccgacaacgacuucgucaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgggcccucuga

SEQ ID NO: 10951 - RNA, 1623 nt, Artificial Sequence
  derived and/or modified sequence opt1 from major_capsid_protein__Norovirus__AFU92723
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgggcccucuga

SEQ ID NO: 10952 - RNA, 1647 nt, Artificial Sequence
  derived and/or modified sequence opt1 from major_capsid_protein__Norovirus__AGD79474
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacggccgggcgcuucacccccaagcucggcagccuggagaucuccaccgagagcgacgacuucgaccagaaccagccgacccgguucacgcccgugggcaucggggucgaccgcgaggccgacuuccagcaguggucccugcccgacuacagcggccaguucacccacaacaugaaccucgcccccgcgguggccccgaacuuccccggggagcagcugcuguucuuccggucccagcuccccagcuccggcgggcgcagcaacggcgugcuggacugccuggucccccaggagugggugcagcacuucuaccaggaguccgccccggcccagacccagguggcccucguccgcuacgugaaccccgacaccggccgggugcuguucgaggcgaagcugcacaagcucggguucaugacgaucgccaagaacggcgacagccccaucaccgugcccccgaacggguacuuccgcuucgaguccugggucaaccccuucuacacccuggcccccaugggcaccgggaacggccggcgccgggugcaguga

SEQ ID NO: 10953 - RNA, 1647 nt, Artificial Sequence
  derived and/or modified sequence opt1 from major_capsid_protein__Norovirus__AGD79475
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugauccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgugacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcccacgaggccaagguggacaccacggcggggcgcuucacccccaagcucggcagccuggagaucuccaccgagagcgacgacuucgaccagaaccagccgacccgguucacgcccgucggcaucgggguggaccgcgaggccgacuuccagcaguggucccugcccgacuacagcggccaguucacccacaacaugaaccucgcccccgccguggcgccgaacuuccccggggagcagcugcuguucuuccggucccagcuccccagcuccggcgggcgcagcaacggcauccuggacugccuggucccccaggagugggugcagcacuucuaccaggaguccgccccggcccagacccagguggcccucguccgcuacgugaaccccgacaccggccgggugcuguucgaggccaagcugcacaagcucggguucaugacgaucgcgaagaacggcgacagccccaucaccgugcccccgaacggguacuuccgcuucgaguccugggucaaccccuucuacacccuggcccccaugggcaccgggaacggccggcgccggauccaguga

SEQ ID NO: 10954 - RNA, 1647 nt, Artificial Sequence
  derived and/or modified sequence opt1 from major_capsid_protein__Norovirus__AGD79476
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacaccacgacccgggcgcacgaggccaaggucgacaccaccagcgggcgcuucacgcccaagcucggcucccuggagaucagcaccgaguccgacgacuucgaccagaacaagccgacccgguucacccccgugggcaucggggucgaccacgaggccgacuuccagcaguggacgcugcccgacuacgccggccaguucacccacaacaugaaccucgcgcccgccguggugccgaacuuccccggggagcagcugcuguucuuccgcagccagcuccccuccagcggcgggcgguccaacggcauccuggacugccuggucccccaggagugggugcagcacuucuaccaggagagcgccccgucccagagccagguggcccucguccgcuacaucaaccccgacaccggccgcgugcuguucgaggccaagcugcacaagcucggguucaugaccaucgcgaagaacggcgacucccccaucacggugcccccgaacggguacuuccgguucgagagcugggucaaccccuucuacacccuggcccccaugggcaccgggaacggccgccggcgcauccaguga

SEQ ID NO: 10955 - RNA, 1647 nt, Artificial Sequence
  derived and/or modified sequence opt1 from major_capsid_protein__Norovirus__AGD79477
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacaccagcacgcgggcgcacgaggccaagaucgacaccaccuccgggcgcuucacccccaagcucggcagccuggagaucuccacggagagcgacgacuucgaccagaacaagccgacccgguucacccccgucggcaucgggguggaccacgagaccgacuuccagcaguggacgcugcccgacuacgccggccagcucacccacaacaugaaccuggcccccgcggucgccccgaacuuccccggggagcagcuccuguucuuccgcucccagcugcccagcuccggcgggcggagcaacggcauccuggacugccucgugccccaggagugggugcagcacuucuaccaggaguccgccccgagccagucccaggucgcccuggugcgcuacaucaaccccgacaccggccgcgugcuguucgaggccaagcuccacaagcugggguucaugaccaucgcgaagaacggcgacagccccaucacggugcccccgaacggguacuuccgguucgaguccugggucaaccccuucuacacccuggcccccaugggcaccgggaacggccgccggcgcauccaguga

SEQ ID NO: 10956 - RNA, 1647 nt, Artificial Sequence
  derived and/or modified sequence opt1 from major_capsid_protein__Norovirus__AGD79478
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacgagaccccguacgaccccgccgagggcauccccgggccgcugggcacccccgacuuccgggggaagguguucggcguggccucccagcgcaaccccgacaccacgacccgggcgcacgaggccaaggucgacaccaccagcgggcgcuucacgcccaagcucggcucccuggagaucagcaccgaguccgacgacuucgaccagaacaagccgacccgguucacccccgugggcaucggggucgaccacgaggccgacuuccagcaguggacgcugcccgacuacgccggccaguucacccacaacaugaaccucgcgcccgccguggccccgaacuuccccggggagcagcugcuguucuuccgcagccagcuccccuccagcggcgggcgguccaacggcauccuggacugccuggugccccaggaguggguccagcacuucuaccaggagagcgccccgucccagagccagguggcccucgugcgcuacaucaaccccgacaccggccgcguccuguucgaggcgaagcugcacaagcucggguucaucaccaucgccaagaacggcgacucccccaucacggugcccccgaacggguacuuccgguucgagagcugggugaaccccuucuacacccuggcccccaugggcaccgggaacggccgccggcgcauccaguga

SEQ ID NO: 10957 - RNA, 1647 nt, Artificial Sequence
  derived and/or modified sequence opt1 from major_capsid_protein__Norovirus__AGD79479
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacaccacgacccgggcgcacgaggccaaggucgacaccaccagcgggcgcuucacgcccaagcucggcucccuggagaucagcaccgaguccgacgacuucgaccagaacaagccgacccgguucacccccgugggcaucggggucgaccacgaggccgacuuccagcaguggacgcugcccgacuacgccggccaguucacccacaacaugaaccucgcgcccgccguggccccgaacuuccccggggagcagcugcuguucuuccgcagccagcuccccuccagcggcgggcggaccaacggcauccuggacugccuggugccccaggaguggguccagcacuucuaccaggaguccgccccgagccagucccagguggcccucgugcgcuacaucaaccccgacaccggccgcguccuguucgaggcgaagcugcacaagcucggguucaucacgaucgccaagaacggcgacagccccaucaccgugcccccgaacggguacuuccgguucgaguccugggugaaccccuucuacacccuggcccccaugggcaccgggaacggccgccggcgcauccaguga

SEQ ID NO: 10958 - RNA, 1620 nt, Artificial Sequence
  derived and/or modified sequence opt1 from major_capsid_protein__Norovirus__AGH24750
augaagauggccagcaacgacaccauccccuccgacggcagcaccgccaaccuggugccggaggucaacaacgaggugauggcgcucgagcccguggucggggccgccaucgccgcccccguggcgggccagcagaacgugaucgaccccuggauccgcaacaacuucguccaggcccccgggggcgaguucacggugagcccccggaacgcccccggggagauccugugguccaugccccuguccccggaccucaaccccuaccugagccaccugucccgcauguacaacggcuacgccggcggguucgaggugcaggucauccucgcgggcaacgccuucaccgccgggaagaucaucuucgccgccaucccgcccaacuucccgaccgacggccugagccccucccaggugaccauguucccccacaucaucguggacguccggcagcuggagcccgugcucaucccgcugcccgacgugcgcaacaacuucuaccacuacaaccaggucaacgacagcacgcugaagcucaucgcgaugcuguacacgccccugcgggccaacaacgccggggacgacguguucaccguguccugccgcguccucacccggcccagcccggacuucgacuucaucuuccuggugccgcccaccguggagucccgcaccaagcccuucaccguccccauccugaccguggacgagaugacgaacagccgguuccccacgccccucgagcgccugcacaccggccccaacaacucccuggugguccagccgcagaacggccggugcaccaucgacggggugcuccugggcaccacccagcugagcgccgucaacaucugcuccuuccgcggggacagcaccacccgggagggccagucccacgccuacacgaugaaccucgcgagccagaacuggaccaacuacgaccccaccgaggacauccccgccccgcugggcacccccgacuucguggggaagaucgugggcaugcugagccagacgacccgcgagaacuccagcacccgggcccacaaggccaccgucuccacgggggacgcccacuucaugcccaagcucggcagcgugcuguucaccaccgacaccgaggaccugcagaacgggcagaacacgcgcuucacccccgugggcgucgcgcaggacggcgagccgcaccagaacgagccccagcaguggcggcuccccaacuacuccgggacccccggccacaacgugcaccuggccccgcccguggcccccaccuuccccggggagcagcuccuguucuuccgcagcacgaugccgggcugcgggggcuaccccaacauggaccuggacugccugcucccccaggaguggguccggcacuucuaccaggaggccgcccccgcgcaguccgacguggcccugcugcgcuucgugaacccggacaccggccggguccucuucgagugcaagcugcacaaggccggguacaucaccgugagccacaccggccccuacgaccuggugaucccgcccaacggguacuuccgcuucgacuccugggucaaccaguucuacgcccucgcgcccaugggcaccgggacgggccgccggcgcgcccuguga

SEQ ID NO: 10959 - RNA, 1623 nt, Artificial Sequence; identical to SEQ ID NO: 9382
  derived and/or modified sequence opt1 from major_capsid_protein__Norovirus__AGI37922

SEQ ID NO: 10960 - RNA, 1623 nt, Artificial Sequence
  derived and/or modified sequence opt1 from major_capsid_protein__Norovirus__AGM46344
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgggcccucuga

SEQ ID NO: 10961 - RNA, 1623 nt, Artificial Sequence
  derived and/or modified sequence opt1 from major_capsid_protein__Norovirus__AGM46347
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucuccccgaagcugggccgggugcaguucgccaccgacaccgacaacgacuucgacgccaaccagaacaccaaguucacgcccgucggggugauccaggacggcgacaccgcccaccgcaacgagccccagcagugggugcugcccagcuacuccgggcggaacagccacaacguccaccucgcgccggccguggcccccaccuuccccggcgagcagcugcuguucuuccgcuccaccaugcccgggugcagcggcuacccgaacauggaccucgacugccugcugccccaggagugggugcaguacuucuaccaggaggccgcgcccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcgcucuga

SEQ ID NO: 10962 - RNA, 1623 nt, Artificial Sequence; identical to SEQ ID NO: 8882
  derived and/or modified sequence opt1 from major_capsid_protein__Norovirus__AGM46349

SEQ ID NO: 10963 - RNA, 1623 nt, Artificial Sequence; identical to SEQ ID NO: 8882
  derived and/or modified sequence opt1 from major_capsid_protein__Norovirus__AGM46355

SEQ ID NO: 10964 - RNA, 1623 nt, Artificial Sequence
  derived and/or modified sequence opt1 from major_capsid_protein__Norovirus__AGM46359
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccagcucccgcaacuacaccaugaaccuggccagccagaacuggagcuccuacgacccgaccgaggagauccccgcgccccugggcacgcccgacuucgucgggaagauccagggcgugcucacccagaccacccggacggacgggagcacccgcggccacaaggccaccguguacaccggguccgccgacuucagcccgaagcugggccggguccaguucgacacggacaccgacaacgacuucgagaccaaccagaacaccaaguucacgcccgugggcgugauccaggacggguccaccaccuaccgcaacgagccccagcaguggguccugcccagcuacuccggccggaacacccacaacgugcaccucgccccggccguggcccccacguuccccggggagcagcugcuguucuuccgcagcaccaugcccggcugcuccggguacccgaacauggaccucgacugccugcugccccaggaguggguccaguacuucuaccaggaggccgcgcccgcccagagcgacguggcccuccugcgguucgugaaccccgacaccggccgcguccuguucgagugcaagcuccacaaguccggcuacgugaccguggcccacaccgggcagcacgaccuggucaucccgcccaacggcuacuuccgguucgacagcugggugaaccaguucuacacgcuggcgcccauggggaacggcaccgggcgccgccgggcccucuga

SEQ ID NO: 10965 - RNA, 1623 nt, Artificial Sequence
  derived and/or modified sequence opt1 from major_capsid_protein__Norovirus__AGM46362
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcuccagccgcaacuacaccaugaaccuggccagccagaacugguccagcuacgacccgaccgaggagauccccgcgccccugggcacgcccgacuucgucgggaagauccagggcgugcucacccagaccacccggacggacggguccacccgcggccacaaggccaccguguacaccgggagcgccgacuucuccccgaagcugggccggguccaguucgacacggacaccgacaacgacuucgagaccaaccagaacaccaaguucacgcccgugggcgugauccaggacgggagcaccaccuaccgcaacgagccccagcaguggguccugcccuccuacagcggccggaacacccacaacgugcaccucgccccggccguggcccccacguuccccggggagcagcugcuguucuuccgcuccaccaugcccggcugcagcggguacccgaacauggaccucgacugccugcugccccaggaguggguccaguacuucuaccaggaggccgcgcccgcccaguccgacguggcccuccugcgguucgugaaccccgacaccggccgcguccuguucgagugcaagcuccacaagagcggcuacgugaccguggcccacaccgggcagcacgaccuggucaucccgcccaacggcuacuuccgguucgacuccugggugaaccaguucuacacgcuggcgcccauggggaacggcaccgggcgccgccgggcccucuga

SEQ ID NO: 10966 - RNA, 1623 nt, Artificial Sequence
  derived and/or modified sequence opt1 from major_capsid_protein__Norovirus__AGM46366
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggcucccgccgcgcccucuga

SEQ ID NO: 10967 - RNA, 1623 nt, Artificial Sequence; identical to SEQ ID NO: 8882
  derived and/or modified sequence opt1 from major_capsid_protein__Norovirus__AGM46367

SEQ ID NO: 10968 - RNA, 1623 nt, Artificial Sequence
  derived and/or modified sequence opt1 from major_capsid_protein__Norovirus__AGM46370
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccacgcagaacuggaacuccuacgacccgaccgaggagauccccgcgccccuggggacccccgacuucgucggcaagauccagggggugcucacccagacgacccgggccgacggcagcacccgcgggcacaaggccaccguguacacgggcagcgccgacuucgccccgaagcugggccggguccaguucgccaccgacaccgacaacgacuucgacgccaaccagaacaccaaguucacgcccgugggggugauccaggacggcgacaccgcgcaccgcaacgagccccagcaguggguccugcccuccuacagcgggcggaacucccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacacgggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggaccggccgccgccgggcccucuga

SEQ ID NO: 10969 - RNA, 1623 nt, Artificial Sequence; identical to SEQ ID NO: 10968
  derived and/or modified sequence opt1 from major_capsid_protein__Norovirus__AGM46375

SEQ ID NO: 10970 - RNA, 1623 nt, Artificial Sequence
  derived and/or modified sequence opt1 from major_capsid_protein__Norovirus__AGM46377
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacgugacgcacaucaccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgcgaaccagaacaccaaguucacccccgucggggugauccaggacggcgacacggcccaccgcaacgagccccagcagugggugcugcccuccuacagcgggcggaacucccacaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcccuccugcgguucgugaaccccgacaccggccgcgugcuguucgagugcaagcuccacaaguccggguacgucacgguggcgcacaccggccagcacgaccuggugaucccgcccaacggguacuuccgguucgacagcugggucaaccaguucuacacccuggcccccaugggcaacgggaccggccgccgccgggcccucuga

SEQ ID NO: 10971 - RNA, 1623 nt, Artificial Sequence; identical to SEQ ID NO: 10968
  derived and/or modified sequence opt1 from major_capsid_protein__Norovirus__AGM46379

SEQ ID NO: 10972 - RNA, 1623 nt, Artificial Sequence; identical to SEQ ID NO: 10968
  derived and/or modified sequence opt1 from major_capsid_protein__Norovirus__AGM46384

SEQ ID NO: 10973 - RNA, 1623 nt, Artificial Sequence
  derived and/or modified sequence opt1 from major_capsid_protein__Norovirus__AGM46386
augaagaugggcagcaacgacgccaaccccuccgacgggagcaccgccaaccuggugccggaggucaacaacgaggugauggcgcucgagcccguggucggcgccgccaucgccgcccccguggcggggcagcagaacgugaucgaccccuggauccgcaacaacuucguccaggccccgggcggggaguucaccgugagcccccggaacgcccccggcgagauccugugguccgcgccccugggcccggaccucaaccccuaccugucccaccuggcccgcauguacaacggguacgccggcggguucgaggugcaggucauccucgccggcaacgccuucacggccgggaagaucaucuucgcggccgugccgcccaacuuccccaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccgggccgagcuccgcguucgucgugcagccccagaacggccgcugcacgaccgacgggguccuccugggcaccacccagcucagccccgugaacaucugcacguuccggggcgacgugacccacaucccggggucccgcaacuacaccaugaaccuggccagccagaacuggaacuccuacgaccccaccgaggagauccccgcgccccugggcacgccggacuucgucgggaagauccagggcgugcucacccagaccacccggacgaacgggagcacccgcggccacaaggccaccguguacaccggcagcgccgacuucucccccaagcuggggcggguccaguucgccacggacaccgacaacgacuucgagaccaaccagaacaccaaguucacgcccgugggcgugauccaggacgggagcaccacgccccgcaacgagccgcagcaguggguccugcccuccuacagcggccggaacauccacaacgugcaccucgcccccgccguggcccccaccuucccgggggagcagcugcuguucuuccgcuccaccaugcccggcugcagcggcuaccccaacauggaccucgacugccugcugccccaggaguggguccaguacuucuaccaggaggccgcgccggcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgggcccucuga

SEQ ID NO: 10974 - RNA, 1623 nt, Artificial Sequence
  derived and/or modified sequence opt1 from major_capsid_protein__Norovirus__AGM46388
augaagaugggcagcaacgacgccaaccccuccgacgggagcaccgccaaccuggugccggaggucaacaacgaggugauggcgcucgagcccguggucggcgccgccaucgccgcccccguggcggggcagcagaacgugaucgaccccuggauccgcaacaacuucguccaggccccgggcggggaguucaccgugagcccccggaacgcccccggcgagauccugugguccgcgccccugggcccggaccucaaccccuaccugucccaccuggcccgcauguacaacggguacgccggcggguucgaggugcaggucauccucgccggcaacgccuucacggccgggaagaucaucuucgcggccgugccgcccaacuuccccaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccgggccgagcuccgcguucgugguccagccccagaacggccgcugcacgaccgacggggugcuccugggcaccacccagcucagccccgucaacaucugcacguuccggggcgacgugacccacaucaccgggucccgcaacuacaccaugaaccuggccacgcagaacuggaacagcuacgacccgaccgaggagauccccgcgccccugggcacccccgacuucguggggaagauccagggcguccucacccagacgacccgggccgacggguccacccgcggccacaaggccaccguguacacgggcagcgccgacuucgccccgaagcuggggcgggugcaguucgccaccgacaccgacaacgacuucgacgccaaccagaacaccaaguucacgcccgucggcgugauccaggacggggacaccgcccaccgcaacgagccccagcagugggugcugcccagcuacuccggccggaacagccacaacguccaccucgcgccggccguggcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgggcgcucuga

SEQ ID NO: 10975 - RNA, 1623 nt, Artificial Sequence
  derived and/or modified sequence opt1 from major_capsid_protein__Norovirus__AGM46392
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaucgacggcgugcuccuggggaccacccagcucucccccgucaacaucugcaccuuccggggcgacgugacgcacaucaccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgccaaccagaacaccaaguucacccccgucggggugauccaggacggcaacacggcgcaccgcaacgagccccagcagugggugcugcccuccuacagcgggcggaacucccacaacguccaccucgccccggccguggcccccaccuuccccggcgagcaguuccuguucuuccgcagcaccaugcccgggugcuccggcuacccgaacauggaccuggacugccuccugccccaggagugggugcaguacuucuaccaggaggcggcccccgcccagagcgacgucgcccugcuccgguucgugaaccccgacaccggccgcgugcuguucgagugcaagcugcacaaguccggguacgucacgguggcccacaccggccagcacgaccucgugaucccgcccaacggguacuuccgguucgacagcugggucaaccaguucuacacccuggcgcccaugggcaacgggaccggccgccgccgggcccuguga

SEQ ID NO: 10976 - RNA, 1623 nt, Artificial Sequence; identical to SEQ ID NO: 9382
  derived and/or modified sequence opt1 from major_capsid_protein__Norovirus__AGM46395

SEQ ID NO: 10977 - RNA, 1623 nt, Artificial Sequence
  derived and/or modified sequence opt1 from major_capsid_protein__Norovirus__AGM46398
augaagauggccagcuccgacgccaaccccagcgacggcuccaaggcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgacgugacgcacaucccgggcagccgcaacuacaccaugaaccuggccucccagaacuggaacagcuacgaccccaccgaggagauccccgcgccccuggggaccccggacuucgucggcaagauccagggggugcucacgcagaccacccggaccaacggcagcacgcgcgggcacaaggccaccguguacaccggcuccgccgacuucagccccaagcugggccggguccaguucgccaccgacacggacaacgacuucgagaccaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggcucccgccgcgcccucuga

SEQ ID NO: 10978 - RNA, 1623 nt, Artificial Sequence; identical to SEQ ID NO: 8882
  derived and/or modified sequence opt1 from major_capsid_protein__Norovirus__AGM46401

SEQ ID NO: 10979 - RNA, 1623 nt, Artificial Sequence; identical to SEQ ID NO: 8882
  derived and/or modified sequence opt1 from major_capsid_protein__Norovirus__AGM46403

SEQ ID NO: 10980 - RNA, 1623 nt, Artificial Sequence
  derived and/or modified sequence opt1 from major_capsid_protein__Norovirus__AGM46407
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgagccugggccccgaccucaacccguaccugucccaccuggcccgcauguacaacggcuacgccgggggcuucgaggugcaggucauccucgccgggaacgccuucacggcgggcaagaucaucuucgccgccgugccgcccaacuuccccaccgaggggcugagcccgucccaggugaccauguucccccacaucaucgucgacgugcggcagcuggagcccgugcucaucccccugccggacguccgcaacaacuucuaccacuacaaccagagcaacgaccccaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 10981 - RNA, 1623 nt, Artificial Sequence
  derived and/or modified sequence opt1 from major_capsid_protein__Norovirus__AGM46409
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccgcaacgagccccagcagugggugcuccccagcuacuccgggcggaacguccagaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 10982 - RNA, 1623 nt, Artificial Sequence; identical to SEQ ID NO: 10002
  derived and/or modified sequence opt1 from major_capsid_protein__Norovirus__AGM46413

SEQ ID NO: 10983 - RNA, 1623 nt, Artificial Sequence
  derived and/or modified sequence opt1 from major_capsid_protein__Norovirus__AGM46415
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccacaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcgcggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccggaacgagccccagcagugggugcuccccuccuacagcgggcgcaacgucccgaacgugcaccuggcccccgccguggcgcccaccuuccccggcgagcagcuccucuucuuccgguccacgaugccgggcugcagcggguaccccaacauggaccuggacugccugcucccccaggaguggguccagcacuucuaccaggaggccgcccccgcccaguccgacguggcgcugcugcgcuucgugaacccggacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgggcccuguga

SEQ ID NO: 10984 - RNA, 1623 nt, Artificial Sequence
  derived and/or modified sequence opt1 from major_capsid_protein__Norovirus__AGM46419
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcauccccgacuucguggggaagauccagggcguccugacgcagaccaccaagggggacggcuccacccggggccacaaggccacgguguacaccgggagcgcccccuucaccccgaagcugggcagcgugcaguucuccaccgacacggagaacgacuucgagacccaccagaacaccaaguucacccccgucggggugauccaggacggcgggacgacccaccgcaacgagccccagcagugggugcuccccagcuacuccggccggaacguccagaacgugcaccuggccccggccguggcgcccaccuuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggaccggccgccggcgcgcccuguga

SEQ ID NO: 10985 - RNA, 1623 nt, Artificial Sequence
  derived and/or modified sequence opt1 from major_capsid_protein__Norovirus__AGM46421
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcacccccuucacgccgaagcugggguccgugcaguucagcaccgacaccgagaacgacuucgagacccaccagaacacgaaguucacccccgucggcgugauccaggacgggggcaccacccaccgcaacgagccccagcagugggugcuccccuccuacagcgggcggaacguccagaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 10986 - RNA, 1623 nt, Artificial Sequence
  derived and/or modified sequence opt1 from major_capsid_protein__Norovirus__AGM46425
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcguguacaccaugaaccuggccucccugaacuggaacaacuacgaccccaccgaggagaucccggcgccccucgggacgcccgacuucgucggcaagauccagggggugcugacccagaccaccaaggaggacggcagcacgcgggggcacaaggccaccguguacaccggcagcgcccccuucaccccgaagcugggcuccguccaguucagcacggacaccgagaacgacuucgagacccaccagaacaccaaguucacgcccgugggggugauccaggacggcgggaccacccaccgcaacgagccccagcaguggguccuccccuccuacagcggccggaacgccccgaacgugcaccuggcccccgcgguggcccccaccuuccccggggagcagcuccucuucuuccgcuccacgaugccgggcugcagcggcuaccccaacauggaccuggacugccugcucccccaggaguggguccagcacuucuaccaggaggccgcccccgcgcaguccgacguggcccugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 10987 - RNA, 1623 nt, Artificial Sequence
  derived and/or modified sequence opt1 from major_capsid_protein__Norovirus__AGM46427
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucccgcccgucaacaucugcacguuccggggcgacgugacccacaucgccggcucccgcguguacaccaugaaccuggccagccugaacuggaacaacuacgaccccaccgaggagauccccgcgccccucgggacgcccgacuucgucggcaagauccagggggugcugacccagaccaccaaggaggacggcuccacgcgggggcacaaggccaccguguacaccggcagcgccccguucacccccaagcugggcagcguccaguucuccacggacaccgagaacgacuucgagacccaccagaacaccaaguucacgcccgugggggugauccaggacggcgggaccacccaccgcaacgagccccagcaguggguccucccgagcuacuccggccggaacgcccccaacgugcaccuggcccccgcgguggcccccaccuucccgggggagcagcuccucuucuuccgcagcacgaugcccggcugcuccggcuaccccaacauggaccuggacugccugcucccccaggaguggguccagcacuucuaccaggaggccgccccggcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10988 - RNA, 1623 nt, Artificial Sequence; identical to SEQ ID NO: 10106
  derived and/or modified sequence opt1 from major_capsid_protein__Norovirus__AGM46431

SEQ ID NO: 10989 - RNA, 1671 nt, Artificial Sequence
  derived and/or modified sequence opt1 from major_capsid_protein__Norovirus__AGN11430
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggaggucgugagcgccucccaggccacccaguucccccacgugaucaucgacguccggacccuggaccccgugcgccucccccugccggacgugcggagcacguucuuccacuacaccaacgacaccgagcccaagaugcgccuggucaucuggcucuacacgccccugcggaccaacggcuccggggacgacagcuucaccguguccggccgcauccugacccggcccagccaggacuucgaguucgccuuccucaucccgcccaccguggagacgaagaccacccccuucuccguccccggcuucagcgugcaggagauguccaacagccgcuggccggccgcgaucuccgccauggugguccgggggaacgagccccaggugguccaguuccagaacggccgcgcccaccuggacgggaugcugcucggcaccacgcccgugagccccaacuacaucgccagcuaccggggcaucuccaccgggaacagccgcuccgccagcccggaggcggacgagcgggccgugggcuccuucgacgucugggugcgccugcaggagcccgacgggcagcccuacgacaucuucggcaagcagccggcccccaucgggacccccgacuucaaggccgugaucgucggcuucgccgcgcggccccugaccagcggcuccuacgccaacgaggccuacgugaacacgaccgccagcaacuacgcgccggccaccgggaacaugcgcuucaccgugcggaacggcgggacgggccacaccuccgccaacaaguacugggaguucaagagcuucggggucgagggcgagcgccacaccggcauccaguaccaggaguacgagcuccccgacuacuccggccagguggccagcaaccacaaccuggccccgcccguggcgccccggaugcccggggagucccugcuccuguuccagagcaacaugcccgucugggacgacgggcacggcgaguccacccccaagaagauccacugccugcucccgcaggaguucaucgggcacuucuucgacaagcaggcccccagccugggcgacgccgcccugcuccgcuacgugaaccaggagacgaaccgggugcuguucgagugcaagcuguaccgcgacggcuacaucaccgucgccgcguccagcgggcuccuggacuucccccuggacggcuucuuccgcuucgacuccugggugagcagcuucuacauccucucccccguggggagcggccagggccggcgcgggcggguccgcuuccaguga

SEQ ID NO: 10990 - RNA, 1647 nt, Artificial Sequence
  derived and/or modified sequence opt1 from major_capsid_protein__Norovirus__AGO64038
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccagguggugcuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacccgaagcuccgccugaucgccaugcuguacacgccccuccgggccaacaacagcggcgacgacgucuucaccguguccugccgcgugcugacccggcccagccccgacuucuccuucaacuuccuggucccgcccaccguggagagcaagaccaagcccuucacgcuccccauccugaccaucuccgagaugagcaacucccgcuucccggugcccaucgacagccugcacaccucccccaccgagaacaucgucgugcagugccagaacgggcgggugacgcucgacggcgagcugauggggaccacccagcugcuccccagccagaucugcgccuuccgcggcguccugacccgguccacgagccgcaccuccgaccaggccgacaccgcgaccccgcggcuguucaacuacuacuggcacauccagcucgacaaccugaacggcacgcccuacgaccccgccgaggacaucccggggccccugggcacccccgacuuccgcgggaagguguucggcguggccagccagcggaaccccgacagcaccacccgcgcccacgaggccaaggucgacacgaccgcggggcgguucaccccgaagcucggcucccuggagaucagcaccgaguccgacgacuucgaccagaaccagcccacgcgcuucacccccgugggcaucggggucgacaacgaggccgacuuccagcaguggagccugcccgacuacuccggccaguucacccacaacaugaaccucgccccggccguggcgcccaacuuccccggggagcagcugcuguucuuccggagccagcuccccuccagcggcgggcgcuccaacggcauccuggacugccuggugccgcaggaguggguccagcacuucuaccaggagagcgcccccgcccagacccagguggcccucgugcgguacgucaaccccgacacgggccgcgugcuguucgaggccaagcugcacaagcucggguucaugaccaucgcgaagaacggcgacucccccaucaccgugccgcccaacggguacuuccgcuucgagagcugggucaaccccuucuacacccuggcccccaugggcacggggaacggccggcgccggauccaguga

SEQ ID NO: 10991 - RNA, 1623 nt, Artificial Sequence
  derived and/or modified sequence opt1 from major_capsid_protein__Norovirus__AGO64040
augaagauggccagcaacgacgccgcgcccuccaacgacggcgccgccgggcuggugcccgagaucaacaacgaggucaugccccucgagcccguggccggcgccagccccgcgaccccgguggucgggcagcagaacaucaucgaccccuggauccgcaacaacuucgugcaggcccccgccggcgaguucaccgugagcccccggaacuccccgggggagauccugcuggaccucgagcugggccccgagcugaaccccuaccucgcccaccuggcgcgcauguacaacggccacgccgggggcauggagguccagaucgugcuggccgggaacgccuucacggccggcaagaucaucuucgcggccaucccgcccggguucccccacgagaaccucucccccagccagaucaccaugugcccccacgugaucaucgacguccggcagcuggagccggugcugcuccccaugcccgacauccgcaacaacuucuuccacuacaaccagggcaacgaccccaagcugcggcugaucgccaugcucuacaccccgcugcgcgccaacaacuccggcgacgacguguucaccgucagcugccgggugcugacgaagcccucccccgacuucgaguucaccuuccucgugcccccgaccgucgagagcaagaccaagcaguucacgcugcccauccugaagaucuccgagaugaccaacagccgcuuccccgugcccguggagaugauguacaccgcccggaacgagaaccaggucgugcagccgcagaacgggcgcgugacccucgacggcgagcugcuggggacgacgccccuccugggcaucgacaucugcaaguucaagggcgaggucaucgcgaagaaccgggacgaccgcuccuaccggauggacauggagaucaccaacaccgacgggacccccaucgacccgaccgaggacacccccggccccaucgggagccccgacuuccgcggcauccuguucgggguggccucccagcggaacaagaacgagcagaacccggccacccgcggccacgaggccaacaucaacacgggcgggaaccaguacgcccccaagcucgcccaggugaaguucuucagcgaguccgacgacuucgacgagcaccagcccaccgucuucacccccgugggcgucgccggggacgacagccacccguuccggcagugggugcugccccgcuacggcgggcaccugaccaacaacacgcaccucgcccccgccguggcgccccuguucccgggcgagcagauccuguucuuccggucccagauccccagcagcggcggguucgagcucggcuacauggacugccuggucccccaggagugggugcagcacuucuaccaggaggcggccaccgcccaguccgacguggcccugauccgcuucaucaaccccgacaccgggcggguccucuucgaggcgaagcugcacaagcagggcuucaucaccguggcccacacgggggacaacccgaucgugaugccgcccaacggcuacuuccgcuucgaggccugggucaaccaguucuacagccuggcccccgugggcaccgggaacggccgccggcgcgugcaguga

SEQ ID NO: 10992 - RNA, 1608 nt, Artificial Sequence
  derived and/or modified sequence opt1 from major_capsid_protein__Norovirus__AGO64042
augaagauggccagcaacgacgccgcgcccuccaacgacggcgccgccgggcuggugccggaggccaacaacgagaccauggcccucgagcccgucgcgggcgccagcaucgccgcgccccugaccgggcagaacaacgugaucgaccccuggauccgccugaacuucgugcaggccccgaacggcgaguucacggucagcccccggaacucccccggggagauccuccugaaccuggagcucggccccgagcugaacccguaccuggcccaccucucccgcauguacaacggcuacgccgggggcguggaggugcagguccugcuggccgggaacgccuucaccgcgggcaagcucguguucgccgccgugccgccccacuucccccuggagaacaucagccccgggcagaucaccauguucccccacgucaucaucgacgugcggacccuggagcccgugcuccugccccugccggacguccgcaacuccuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaugggggagcugaccaacucccgcuuccccgugcccaucgacgagcuguacacgagccccaacgagaaccucgugguccagccgcagaacggccggugcgcccuggacggggagcugcagggcaccacccagcuccugcccaccgcgaucugcuccuuccgcggccgggugaaccagaaggugagcggggagaaccacgucuggaacaugcaggucacgaacaucaacggcacccccuucgacccgaccgaggacgugcccgcgccccuggggacccccgacuucuccggccgccucuucggggugcugagccagcgggaccacgacaacgccugccgcucccacgacgccgugaucgccacgaacagcaccaaguucaccccgaagcugggcgccauccagaucggcaccugggaggaggacgacguccacaucaaccagcccacgaaguucacccccgugggccucuucgacaccgacgacuucaaccagugggcccugcccaacuacagcggggcccugacccucaacauggggcuggccccgcccguggcccccacguuccccggcgagcagauccuguucuuccggucccacaucccgcucaagggcggggucgcggaccccgugaucgacugccugcugccccaggaguggauccagcaccucuaccaggagagcgcccccucccagagcgacguggcccugauccgcuucaccaacccggacaccggccggguccuguucgaggccaagcuccaccgcuccggguacaucaccguggcgaacacgggcaaccggcccaucgugguccccgccaacggguacuuccgcuucgacagcugggugaaccaguucuacucccuggcccccaugggcaccgggaacggccgccggcgcgugcaguga

SEQ ID NO: 10993 - RNA, 1623 nt, Artificial Sequence
  derived and/or modified sequence opt1 from major_capsid_protein__Norovirus__AGS41450
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcuccucuucuuccgcagcaccaugcccggcugcuccggcuaccccaacacggaccuggacugccugcucccgcaggaguggguccagcacuucuaccaggaggccgcccccgcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10994 - RNA, 1623 nt, Artificial Sequence
  derived and/or modified sequence opt1 from major_capsid_protein__Norovirus__AGT62521
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgguccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcaggaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgggaacagccagcugaacgugugggcgauccccaaguacggcuccagccuccccgacgucacccaccuggcccccgccguguucccgcccggguucggcgaggugauccuguacuucuacuccaccuuccccgggagcggccagcccucccagcuccaggucccgugccugcugccccaggaguucaucacccacuucugcaacgagcaggcccccaucgcgggcgaggccgcccuccugcacuacguggaccccgacacggggcggaaccugggcgaguucaagcucuacccggacggguucaugaccugcgugcccaacagcgucuccagcggcccccagacccugcccaucaacggcguguucguguucgucuccugggugagccgcuucuaccagcugaagccgguggggaccgccagcgccgcgcggcgccucggccugcggcgcaucuga

SEQ ID NO: 10995 - RNA, 1629 nt, Artificial Sequence
  derived and/or modified sequence opt1 from major_capsid_protein__Norovirus__AGT62523
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcaccaacuucguccaggcgccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucacgauguucccccacgugaucaucgacguccggacccucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguccaagaccaagcccuucacgcugcccauccucacccugggcgagaugagcaacucccgguuccccguccccaucgaccagauguacaccagccccaacgaggugaucuccgugcagugccagaacgggcgcugcacccuggacggcgagcuccaggggacgacccagcugcaggucagcggcaucugcgccuucaagggccaggugaccgcccaccuccaggacaacgagcaccucuacaacgucaccaucacgaaccugaacggguccccguucgaccccagcgaggacauccccgccccgcugggcgugcccgacuucgaggggcggguguucggcgucaucucccagcgcgacaacuacaacagcgggggccagaaccagcccgccaaccggucccacgacgcgguggugcccaccuacaccgcccaguacaccccgaagcucggccagauccagaucgggacguggcagaccgacgacaucaccgucgaccagcccgccaaguucacccccgugggccugagcgacacggaccacuucaaccaguggguggucccccgcuacgccggggcccugaaccucaacaccaaccuggcgccgagcguggcccccguguuccccggcgagcggcugcuguucuuccgcuccuacaucccccugaagggcggguucggcaacccggccaucgacugccuggucccccaggaguggauccagcacuucuaccaggaggccgcgcccagccucuccgagguggcccuggugcgguacaucaaccccgacaccgggcgcgcccuguucgaggccaagcuccaccgggccggcuucaugaccgucagcuccaacacgagcgcgccgguggugguccccgccaacggguacuuccgcuucgacuccugggugaaccaguucuacagccuggcccccaugggcaccgggaacggccggcgccgcauccaguga

SEQ ID NO: 10996 - RNA, 1623 nt, Artificial Sequence; identical to SEQ ID NO: 10200
  derived and/or modified sequence opt1 from major_capsid_protein__Norovirus__AGV40221

SEQ ID NO: 10997 - RNA, 1623 nt, Artificial Sequence
  derived and/or modified sequence opt1 from major_capsid_protein__Norovirus__AGV76553
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacuccgggcagcacgaccuggugaucccgcccaacggcuacuuccgguucgacagcugggucaaccaguucuacacccuggcccccauggggaacggcaccggccgccgccgggcccucuga

SEQ ID NO: 10998 - RNA, 1623 nt, Artificial Sequence; identical to SEQ ID NO: 9501
  derived and/or modified sequence opt1 from major_capsid_protein__Norovirus__AGV76554

SEQ ID NO: 10999 - RNA, 1623 nt, Artificial Sequence; identical to SEQ ID NO: 9501
  derived and/or modified sequence opt1 from major_capsid_protein__Norovirus__AGV76555

SEQ ID NO: 11000 - RNA, 1623 nt, Artificial Sequence; identical to SEQ ID NO: 9501
  derived and/or modified sequence opt1 from major_capsid_protein__Norovirus__AGV76556

SEQ ID NO: 11001 - RNA, 1623 nt, Artificial Sequence; identical to SEQ ID NO: 9501
  derived and/or modified sequence opt1 from major_capsid_protein__Norovirus__AGV76557

SEQ ID NO: 11002 - RNA, 1623 nt, Artificial Sequence; identical to SEQ ID NO: 9501
  derived and/or modified sequence opt1 from major_capsid_protein__Norovirus__AGV76558

SEQ ID NO: 11003 - RNA, 1623 nt, Artificial Sequence; identical to SEQ ID NO: 9501
  derived and/or modified sequence opt1 from major_capsid_protein__Norovirus__AGV76559

SEQ ID NO: 11004 - RNA, 1623 nt, Artificial Sequence; identical to SEQ ID NO: 9501
  derived and/or modified sequence opt1 from major_capsid_protein__Norovirus__AGV76560

SEQ ID NO: 11005 - RNA, 1623 nt, Artificial Sequence; identical to SEQ ID NO: 9501
  derived and/or modified sequence opt1 from major_capsid_protein__Norovirus__AGV76561

SEQ ID NO: 11006 - RNA, 1623 nt, Artificial Sequence; identical to SEQ ID NO: 9501
  derived and/or modified sequence opt1 from major_capsid_protein__Norovirus__AGV76562

SEQ ID NO: 11007 - RNA, 1623 nt, Artificial Sequence; identical to SEQ ID NO: 9501
  derived and/or modified sequence opt1 from major_capsid_protein__Norovirus__AGV76563

SEQ ID NO: 11008 - RNA, 1623 nt, Artificial Sequence
  derived and/or modified sequence opt1 from major_capsid_protein__Norovirus__AGV76564
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccuccauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 11009 - RNA, 1623 nt, Artificial Sequence; identical to SEQ ID NO: 9501
  derived and/or modified sequence opt1 from major_capsid_protein__Norovirus__AGV76565

SEQ ID NO: 11010 - RNA, 1623 nt, Artificial Sequence; identical to SEQ ID NO: 9501
  derived and/or modified sequence opt1 from major_capsid_protein__Norovirus__AGV76566

SEQ ID NO: 11011 - RNA, 1623 nt, Artificial Sequence
  derived and/or modified sequence opt1 from major_capsid_protein__Norovirus__AGV76567
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgggacggacaccgaccacgacuucgaggccaaccagaacaccaaguucacccccgucggcgugauccaggacggguccacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 11012 - RNA, 1623 nt, Artificial Sequence
  derived and/or modified sequence opt1 from major_capsid_protein__Norovirus__AGV76568
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugaucgacgugcggcagcuggagcccguccucaucccgcugcccgacgugcgcaacaacuucuaccacuacaaccagagcaacgaccccaccaucaagcugaucgccaugcucuacacgccccugcgggcgaacaacgccggcgacgacguguucaccgucuccugccgcgugcugacccggccgagccccgacuucgacuucaucuuccucgugccgcccaccgucgagucccgcaccaagcccuucagcgugcccgugcugacggucgaggagaugaccaacucccgguuccccaucccccuggagaagcuguucaccggcccgagcuccgccuucgugguccagccccagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggcccucuga

SEQ ID NO: 11013 - RNA, 1623 nt, Artificial Sequence; identical to SEQ ID NO: 9501
  derived and/or modified sequence opt1 from major_capsid_protein__Norovirus__AGV76569

SEQ ID NO: 11014 - RNA, 1623 nt, Artificial Sequence; identical to SEQ ID NO: 9501
  derived and/or modified sequence opt1 from major_capsid_protein__Norovirus__AGV76570

SEQ ID NO: 11015 - RNA, 1623 nt, Artificial Sequence
  derived and/or modified sequence opt1 from major_capsid_protein__Norovirus__AGV76571
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaucaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcccccgcgguggcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcccucuga

SEQ ID NO: 11016 - RNA, 1623 nt, Artificial Sequence
  derived and/or modified sequence opt1 from major_capsid_protein__Norovirus__AGV76572
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccagcgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacacccacaacguccaccucgccccggcgguggcccccaccuuccccggcgagcagcugcuguucuuccgcuccacgaugcccgggugcagcggcuacccgaacauggaccucgacugccugcugccccaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggccguguga

SEQ ID NO: 11017 - RNA, 1623 nt, Artificial Sequence; identical to SEQ ID NO: 9499
  derived and/or modified sequence opt1 from major_capsid_protein__Norovirus__AGV76573

SEQ ID NO: 11018 - RNA, 1623 nt, Artificial Sequence
  derived and/or modified sequence opt1 from major_capsid_protein__Norovirus__AGV76574
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugaucccccaggagugggugcaguacuucuaccaggaggccgcccccgcgcaguccgacgucgcccugcuccgguucgugaaccccgacaccgggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccauggggaacggcacgggccgccgccgggccguguga

SEQ ID NO: 11019 - RNA, 1623 nt, Artificial Sequence
  derived and/or modified sequence opt1 from major_capsid_protein__Norovirus__AGV76575
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgacaacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugaucccccaggagugggugcaguacuucuaccaggaggccgcccccgcgcaguccgacgucgcccugcuccgguucgugaaccccgacaccgggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccauggggaacggcacgggccgccgccgggccguguga

SEQ ID NO: 11020 - RNA, 1623 nt, Artificial Sequence; identical to SEQ ID NO: 9499
  derived and/or modified sequence opt1 from major_capsid_protein__Norovirus__AHA44844

SEQ ID NO: 11021 - RNA, 1623 nt, Artificial Sequence
  derived and/or modified sequence opt1 from major_capsid_protein__Norovirus__AHA44847
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccgggccgacggcagcacgcgcgggcacaaggccaucgucuacaccggcagcgccgacuucgccccgaagcugggccgggugcaguucgagaccgacaccgaccacgacuucgaggccaaccagaacacgaaguucacccccgugggggucacccaggacggcuccaccacgcaccgcaacgagccccagcagugggugcugcccagcuacuccgggcggaacacccacaacgugcaccucgcgccggccgucgcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgggucguguga

SEQ ID NO: 11022 - RNA, 1623 nt, Artificial Sequence
  derived and/or modified sequence opt1 from major_capsid_protein__Norovirus__AHB62404
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagcagcaacuacaccaugaaccuggccucccagaacuggaacagcuacgaccccaccgaggagaucccggcgccccuggggacgcccgacuucgucggcaagauccagggggugcucacccagaccacccgcacggacggcuccacccgggggcacaaggccaccguguacaccggcagcgccgacuucucccccaagcugggccgcguccaguucgccacggacaccgacaacgacuucgagaccaaccagaacaccaaguucacgccggugggggugauccaggacggcgccaccacccaccggaacgagccccagcaguggguccugcccagcuacuccgggcgcaacacccacaacgugcaccucgcccccgccguggcgccgacguuccccggcgagcagcugcuguucuuccggagcaccaugcccgggugcuccggcuaccccaacauggaccucgacugccugcugccgcaggaguggguccaguacuucuaccaggaggccgcccccgcccagagcgacguggcgcuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccaguucuacacgcuggcccccaugggcaacgggaccggccggcgccgcgcccucuga

SEQ ID NO: 11023 - RNA, 1623 nt, Artificial Sequence; identical to SEQ ID NO: 9501
  derived and/or modified sequence opt1 from major_capsid_protein__Norovirus__AHB62406

SEQ ID NO: 11024 - RNA, 1623 nt, Artificial Sequence
  derived and/or modified sequence opt1 from major_capsid_protein__Norovirus__AID51515
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccccgggaccacccagcuguccccggucaacaucugcaccuuccggggcgacgugacgcacaucaccggcagccgcaacuacaccaugaaccucgccucccagaacuggaacaacuacgaccccaccgaggagauccccgcgccccuggggacgccggacuucgugggcaagauccaggggguccugacccagaccacccggagcgacggcagcacgcgcgggcacaaggccaccguguacaccggcuccgccgacuucgcccccaagcucggccgggugcaguucgagaccgacacggaccgcgacuucgaggccaaccagaacaccaaguucacccccgucggggugauccaggacggcgggaccacgcaccggaacgagccccagcagugggugcugccgagcuacuccggccgcaacacccccaacguccaccuggcccccgcgguggcccccaccuucccgggggagcagcuccuguucuuccggagcaccaugcccggcugcuccggcuaccccaacauggaccuggacugccuccugccccaggagugggugcaguacuucuaccaggaggccgccccggcgcagagcgacgucgcccugcuccgcuucgugaaccccgacacggggcgggugcuguucgagugcaagcugcacaaguccggcuacgucaccguggcccacaccgggcagcacgaccucgugaucccgcccaacggcuacuuccgcuucgacagcugggucaaccaguucuacacccuggcccccauggggaacggcaccggccgccggcgcgcccuguga

SEQ ID NO: 11025 - RNA, 1623 nt, Artificial Sequence; identical to SEQ ID NO: 9493
  derived and/or modified sequence opt1 from major_capsid_protein__Norovirus__AID51517

SEQ ID NO: 11026 - RNA, 1623 nt, Artificial Sequence
  derived and/or modified sequence opt1 from major_capsid_protein__Norovirus__AID51519
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagccgguacgucaccguggcccacaccgggcagcacgaccuggugaucccgcccaacggcuacuuccgcuucgacuccugggucaaccaguucuacacccuggcccccauggggaacggcacggggcgccggcgcgcccucuga

SEQ ID NO: 11027 - RNA, 1623 nt, Artificial Sequence
  derived and/or modified sequence opt1 from major_capsid_protein__Norovirus__AID51522
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccgccggcgcgcccucuga

SEQ ID NO: 11028 - RNA, 1623 nt, Artificial Sequence; identical to SEQ ID NO: 9499
  derived and/or modified sequence opt1 from major_capsid_protein__Norovirus__AID51531

SEQ ID NO: 11029 - RNA, 1623 nt, Artificial Sequence; identical to SEQ ID NO: 9445
  derived and/or modified sequence opt1 from major_capsid_protein__Norovirus__AID51534

SEQ ID NO: 11030 - RNA, 1623 nt, Artificial Sequence; identical to SEQ ID NO: 9445
  derived and/or modified sequence opt1 from major_capsid_protein__Norovirus__AIL49840

SEQ ID NO: 11031 - RNA, 1623 nt, Artificial Sequence
  derived and/or modified sequence opt1 from major_capsid_protein__Norovirus__AIL49843
augaagauggccagcuccgacgccaaccccagcgacggcuccgcggccaaccuggugccggaggucaacaacgaggugauggcccucgagcccuucgugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcugcuggggaccacccagcucucccccgugaacaucugcaccuuccggggcgacgucacgcacaucaccggcagccgcaacuacaccaugaaccuggccucccagaacuggaacaacuacgaccugaccgaggagaucccggcgccccucgggacgcccgacuucgugggcaagauccagggggugcugacccagaccacccggacggacggcagcacccgcgggcacaaggccaccgucuacaccggcagcgccgacuucgcccccaagcugggccgggugcaguucgagacggacaccgaccacgacuucgaggccaaccagaacaccaaguucaccccggugggggucauccaggacggcgggacgacccaccgcuccgagccccagcagugggugcuccccagcuacuccggccggaacacccccaacgugcaccuggccccggcggucgcccccaccuuccccggggagcagcuccucuucuuccgcagcacgaugcccggcugcuccggcuacccgaacauggaccuggacugccugcucccccaggagugggugcaguacuucuaccaggaggccgcccccgcgcagagcgacguggcccugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccgccgggcccuguga

SEQ ID NO: 11032 - RNA, 1623 nt, Artificial Sequence
  derived and/or modified sequence opt1 from major_capsid_protein__Norovirus__AIV99914
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcaccuacaacggcuacgccgggggcuucgaggugcaggucauccucgccgggaacgccuucacggccggcaaggugaucuucgccgccgugccgcccaacuucccgaccgaggggcugucccccagccaggucaccauguucccccacaucgugguggacgcccggcagcuggagcccguccucaucccgcugcccgacgugcgcaacaacuucuaccacuacaaccaguccaacgaccccaccaucaagcugaucgcgaugcucuacacgccccugcgggccaacaacgccggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacucccgcugcacgaccgacggggugcuccugggcaccacccagcucagccccgugaacaucugcacguuccgcggggacgucacccacaucaccggcucccggaacuacaccaugaaccuggccagccagaacuggaacaacuacgacccgacggaggagauccccgugccccugggcacccccgacuucguggggaagauccagggcguccucacccagaccacgcggaccgacgggagcacccgcggccacaaggcgaccguguacacgggguccgccgacuucgccccgaagcugggccgggugcaguucgagaccgacaccgaccacgacuucgaggccaaccagaacaccaaguucacgcccgucggcgugauccaggacgggggcaccacccaccgcaacgagccccagcagugggugcugcccagcuacuccgggcggaacacccacaacguccaccucgccccggcgguggcccccacguuccccggcgagcagcugcuguucuuccgcagcaccaugcccgggugcuccggcuacccgaacauggaccucgacugccugcugccccaggagugggugcaguacuucuaccagggcgccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccauggggaacggcaccggccgccgccgggccguguga

SEQ ID NO: 11033 - RNA, 1635 nt, Artificial Sequence
  derived and/or modified sequence opt1 from major_capsid_protein__Norovirus__AJP13619
auggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcaacagcgacuccuucgucguggcggggcgcgugcugaccgcccccagcuccgacuucagcuuccucuuccuggugcccccgaccaucgagcagaagacccgggccuucaccguccccaacaucccccugcagacgcucuccaacagccgcuuccccucccugauccagggcaugauccugagcccggacgccagccaggugguccaguuccagaacggccggugccucaucgacgggcagcugcugggcaccacccccgccaccuccgggcagcuguuccgcgugcggggcaagaucaaccagggggcgcgcacgcucaaccugaccgagguggacggcaagcccuucauggccuucgacagccccgccccggucggcuuccccgacuucgggaagugcgacuggcacaugcggaucuccaagacccccaacaacaccagcuccggcgacccgaugcgcagcguguccguccagacgaacgugcagggguucgugccccaccucggcagcauccaguucgacgaggucuucaaccaccccaccggggacuacaucggcaccaucgaguggaucucccagcccagcaccccgcccggcacggacaucaaccugugggagauccccgacuacggguccagccugucccaggccgccaaccucgcgcccccgguguucccgcccggcuucggggaggcccugguguacuucgucagcgccuuccccggccccaacaaccgguccgcccccaacgacgugcccugccugcucccccaggaguacaucacccacuucgugagcgagcaggccccgaccaugggggacgcggcccugcugcacuacgucgaccccgacaccaaccgcaaccucggcgaguucaagcuguaccccggcggguaccugacgugcgugcccaacggcgugggggccggcccgcagcagcucccccugaacggcgucuuccuguucguguccugggugagccgguucuaccagcucaagcccgucgggaccgccuccaccgcgcgcggccggcugggggugcgccggaucuga

SEQ ID NO: 11034 - RNA, 1632 nt, Artificial Sequence
  derived and/or modified sequence opt1 from major_capsid_protein__Norovirus__AJP13620
auggccagcaaggacgcccccaccaacauggacggcaccuccggggcgggccagcuggugccggaggccaacacggccgagcccaucagcauggagcccgucgccggggccgugaccgcggccgccaccgccggccaggugaacaugaucgaccccuggaucaugaacaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcaucccgcccggguucguggcgcagaacaucagcaucgcccaggccaccauguucccccacgugaucgccgacguccgggugcuggagcccaucgaggugccccucgaggacguccgcaacgugcuguuccacaacaacgacaacacccccacgaugcggcuggugugcauccucuacacgccccugcgcgccuccggcagcuccagcggcaccgacccguucgucaucgcggggcgggugcugaccugccccucccccgacuucagcuuccucuuccuggugcccccgaacgucgagcagaagaccaagcccuucuccgugcccaaccugccccucaacacccugagcaacucccgcgugccgagccugaucaaguccaugauggucagccgggaccacggccagauggugcaguuccagaacgggcgcgugacccucgacggccagcugcagggcaccacgcccaccuccgccagccagcugugcaagauccgggggagcgucuuccacgccaacggcgggaacggcuacaaccucaccgagcuggacgggucccccuaccacgccuucgagagccccgccccgaucggcuuccccgaccugggcgagugcgacuggcacauggaggcgucccccaccacgcaguucaacaccggggacgugaucaagcagaucaacgucaagcaggagagcgccuucgccccgcaccucggcaccauccaggccgacgggcuguccgacgugagcgugaacaccaacaugaucgccaagcugggcugggucucccccgugagcgacgggcacaagcgcgacguggaccccugggucaucccccgguacggcuccacgcucaccgaggcggcccagcuggccccgcccaucuacccgcccggcuucggggaggccaucguguucuucaugagcgacuuccccaucgcgcacggcaccaacgggcuguccgugcccugcaccaucccccaggaguucgucacgcacuucgugaacgagcaggcccccacccgcggcgaggccgcccuccugcacuaccuggacccggacacccaccggaaccucggggaguucaagcuguaccccgacggcuucaugaccugcgugcccaacacgagcggcaccgggccccagacccugccgaucaacggcgucuucguguucguguccugggucagccgcuucuaccagcucaagcccguggggaccgccggccccgcgcggcgccugggcauccggcgcuccuga

SEQ ID NO: 11035 - RNA, 1647 nt, Artificial Sequence
  derived and/or modified sequence opt1 from major_capsid_protein__Norovirus__AJP13621
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcaccuuccggggcguccugacccgcuccaccagccgggccagcgaccaggcggacacggccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccccgacagcaccacccgggcccacgaggcgaagaucgacaccaccuccgggcgcuucacgcccaagcucggcagccuggagaucuccaccgagagcgacgacuucgaccagaacaagccgacccgguucacccccgucggcaucgggguggaccacgaggccgacuuccagcagugggcccugcccgacuacgccggccaguucacgcacaacaugaaccucgcgcccgccgucgccccgaacuuccccggggagcagcugcuguucuuccgcucccagcuccccagcuccggcgggcggagcaacggcauccuggacugccuggugccccaggagugggugcagcacuucuaccaggaguccgccccgagccagucccaggucgcccucgugcgcuacaucaaccccgacaccggccgcgugcuguucgaggcgaagcugcacaagcucggguucaucaccaucgccaagaacggcgacagccccaucaccgugcccccgaacggguacuuccgguucgaguccugggucaaccccuucuacacgcuggcccccaugggcaccgggaacggccgccggcgcauccaguga

SEQ ID NO: 11036 - RNA, 1653 nt, Artificial Sequence
  derived and/or modified sequence opt1 from major_capsid_protein__Norovirus__AJP13622
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcggccgacuccaccgacagcccgcagcgggcccgcgaccacccccuccacgugcaggucaagaaccuggacgggacccaguacgaccccacggacgacaucccggccgugcugggcgccaucgacuucaagggcaccguguucggggucgcgucccagcgggacgugagcggcacccaggagcaggggcacuacgccacccgcgcccacgaggcccacaucgacacgaccgaccccaaguacgcgcccaagcucggcaccauccugaucaaguccgagagcaccgacuucacgaccaaccagcccauccgguucaccccgguggggaugggcgacaacaacuggcgccagugggagcugcccgacuacagcggccggcucacccugaacaugaaccuggcccccgccgucucccccagcuucccgggggagcgcauccucuucuuccgcuccaucgugcccagcgccggcggguucggcuccggguacaucgacugccugaucccccaggagugggugcagcacuucuaccaggaggccgcgcccagccaguccgccgucgcccuggugcgguacgugaacccggacacgggccgcaacaucuucgaggccaagcuccaccgggagggcuuccugaccgucgccaacagcgggaacaaccccaucguggugccgcccaacggcuacuuccgcuucgaggcgugggucaaccaguucuacacccuggcccccaugggguccggccaggggcggcgccgggcccaguga

SEQ ID NO: 11037 - RNA, 1614 nt, Artificial Sequence
  derived and/or modified sequence opt1 from major_capsid_protein__Norovirus__AJP13623
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggacaaccacguguggaacaugcaggucacgaacaucaacggcacccccuucgacccgaccgaggacgugcccgcgccccuggggacccccgacuucuccggcaagcuguucggggugcucagccagcgcgaccacgacaacgccugccggucccacgacgccgucaucgccacggacagcgccaaguucaccccgaagcugggcgcgauccagaucggcaccugggaggaggacgacgugcacaucaaccagcccaccaaguucacgcccgugggccucuucgagcgcgagggguucaaccaguggacccugcccaacuacagcggggcccugacccucaacaugggccuggccccgcccgucgcccccaccuuccccggggagcagauccuguucuuccggucccacaucccgcucaagggcggcguggccgaccccgugaucgacugccugcugccccaggaguggauccagcaccucuaccaggagagcgcgcccucccagacggacgucgcccugauccgcuucaccaacccggacaccgggcgggugcuguucgaggccaagcuccaccgcagcggcuacaucaccguggccaacacggggucccggcccaucgucgugcccgcgaacggcuacuuccgcuucgacagcugggugaaccaguucuacucccuggcccccauggggaccggcaacggccgccggcgcguccagaagggguga

SEQ ID NO: 11038 - RNA, 1623 nt, Artificial Sequence
  derived and/or modified sequence opt1 from major_capsid_protein__Norovirus__AJW67354
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccguggagcagaagacccgcguguucagcguccccaacaucccccucaaggaccuguccaacagccgggugcccgugccgguccagggcauguucgugucccccgacgugaaccagagcguccaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgugggcuucccggaccugggcgggugcgacuggcacgucaacuucaccuuccagacccaggaccgggaccccagccaguccgugacguucgcgaccaacgacgccagcuucgugcccuaccucggcuccgucagcccccacaacggggagggcuuccaggccggggacaucaucggcucccugggcuggaucagcgccccguccgacaacagccaguucaacgugugggccauccccaaguacggguccagccugcccgacgugacccaccucgcgcccgccgucuucccgcccggcuucggggaggugauccuguacuucuacuccaccuuccccggcagcgggcagcccucccagcugcaggucccgugccuccugccccaggaguucaucacgcacuucugcaacgagcaggcccccaucgccggcgaggcggcccugcuccacuacgucgaccccgacaccggccgcaaccugggggaguucaagcuguacccggacggcuucaugaccugcgugcccaacagcguguccagcgggccccagacccuccccaucaacggcgucuucguguucguguccugggucagccgguucuaccagcugaagccggugggcacggccagcgccgcccgccggcuggggcuccgccggaucuga

SEQ ID NO: 11039 - RNA, 1644 nt, Artificial Sequence
  derived and/or modified sequence opt1 from major_capsid_protein__Norovirus__AJW67357
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgccaucgacuucaagggcaccgucuucgggguggccucccagcggaacaccacgggcaacagcaucggggccacccgcgcccacgaggugcacaucgacaccaccaacccccgguacacgccgaagcugggcagcguccugauguacuccgagagcuccgacuucgacgacgggcagcccacccgcuucacccccaucggcaugggcgcggacgacuggcaccagugggagcuccccgaguacagcgggcaccugacccugaacaugaaccucgccccggccguggcccccgcguuccccggcgagcggauccuguucuuccgcuccgugguccccagcgccgggggcuacggguccggccacaucgacugccugaucccgcaggagugggugcagcacuucuaccaggaggccgcccccagccaguccgccguggcgcucauccgcuacgucaaccccgacacgggccggaacaucuucgaggccaagcugcaccgcgagggguucgugaccguggccaacagcggcaacaaccccaucgucgugccgcccaacggguacuuccgguucgaggccugggugaaccaguucuacacccugacccccaugggcacggggcagggccgccggcgcauccaguga

SEQ ID NO: 11040 - RNA, 1644 nt, Artificial Sequence
  derived and/or modified sequence opt1 from major_capsid_protein__Norovirus__AJW67359
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccaggccucccgcagcgccgacuccaccgacagcgcgccccgggugcgcaaccacccccuccacguccagcugaagaaccuggacgggaccccguacgaccccacggacgaggugcccgccgugcucggcgccaucgacuucaagggcaccgucuucgggguggccucccagcggaacaccaccggcaacagcaucggggccacgcgcgcgcacgaggcccacaucgacaccaccaacccccgguacaccccgaagcugggcagcgugcugauguacuccgagagcuccgacuucgacgacgggcagcccacgcgcuucacccccaucggcaugggcgccgacgacuggcaccagugggagcuccccgaguacagcgggcaccugacccugaacaugaaccucgccccggcggucgcccccgccuuccccggcgagcggauccuguucuuccgcuccguggugcccagcgccgggggcuacggguccggccacaucgacugccugaucccgcaggaguggguccagcacuucuaccaggaggccgcgcccagccaguccgccguggcccucauccgcuacgugaaccccgacaccggccggaacaucuucgaggccaagcugcaccgcgagggguucaucacggucgccaacagcggcaacaaccccaucguggugccgcccaacggguacuuccgguucgaggcgugggucaaccaguucuacacccugacccccaugggcaccgggcagggccgccggcgcgugcaguga

SEQ ID NO: 11041 - RNA, 1644 nt, Artificial Sequence
  derived and/or modified sequence opt1 from major_capsid_protein__Norovirus__AJW67362
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgccaucgacuucaagggcaccgucuucgggguggccucccagcggaacaccacgggcaacagcaucggggccacccgcgcccacgaggugcacaucgacaccaccaacccccgguacacgccgaagcugggcagcguccugauguacuccgagagcaccgacuucgacgacgggcagcccacccgcuucacccccaucggcaugggcgcggacgacuggcaccagugggagcuccccgaguacuccgggcaccugacgcugaacaugaaccucgccccggccguggcccccgcguuccccggcgagcggauccuguucuuccgcagcgugguccccuccgccgggggcuacgggagcggccacaucgacugccugaucccgcaggagugggugcagcacuucuaccaggaggccgcccccucccagagcgccguggcgcucauccgcuacgucaaccccgacaccggccggaacaucuucgaggccaagcugcaccgcgagggguucaucaccguggccaacuccggcaacaaccccaucguggucccgcccaacggguacuuccgguucgaggccugggugaaccaguucuacacccugacgcccaugggcaccgggcagggccgccggcgcgugcaguga

SEQ ID NO: 11042 - RNA, 1617 nt, Artificial Sequence; identical to SEQ ID NO: 10608
  derived and/or modified sequence opt1 from major_capsid_protein__Norovirus__AJW67368

SEQ ID NO: 11043 - RNA, 1617 nt, Artificial Sequence; identical to SEQ ID NO: 10608
  derived and/or modified sequence opt1 from major_capsid_protein__Norovirus__AJW67371

SEQ ID NO: 11044 - RNA, 1623 nt, Artificial Sequence
  derived and/or modified sequence opt1 from major_capsid_protein__Norovirus__AJW67374
auggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggccgcuucacccccaagaucggcaccaucgggcugcacagcaucaccgagaacguccacccgaaccagcagucccgguucacgcccgugggcguggcccagaacgagaacacccccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacacgggccgcacccucuucgaggcgaagcugcaccggagcggguucaucaccgugucccacaccggcaacuacccccugguggucccgcccaacgggcacuuccgcuucgacagcugggugaaccaguucuacucccucgcccccaugggcacggggaacggccgccggcgcgugcaguga

SEQ ID NO: 11045 - RNA, 1635 nt, Artificial Sequence
  derived and/or modified sequence opt1 from major_capsid_protein__Norovirus__AJW67377
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgagaugagcaagauccccaacagcuccacggagagcaaccccaucguggugaacuccgucaagccgaacagccagcaguucgugccccaccucuccagcaucacccuggacgacaacguguccagcggcggggacuacaucggcaccauccaguggaccuccccgcccagcgacuccgggggcgccaacacgaacuucuggaagauccccaacuacggcagcucccuggccgaggcgagccagcucgcccccgccgucuacccgcccggguucaacgaggugaucguguacuucauggccuccauccccggccccaaccagagcgggucccccaaccugguccccugccugcucccgcaggaguacaucacccacuucaucagcgagcaggcccccauccagggcgaggcggcccugcugcacuacguggaccccgacaccaaccggaaccucggggaguucaagcuguaccccggcggcuaccugaccugcgugccgaacuccagcagcacggggccccagcagcucccccuggacggcgucuucguguucgccuccugggugagccgcuucuaccagcugaagcccgucgggaccgccggcccggcgcggggccgccucggggugcggcgcuga

SEQ ID NO: 11046 - RNA, 1617 nt, Artificial Sequence
  derived and/or modified sequence opt1 from major_capsid_protein__Norovirus__AJX18190
auggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagcccgccccagaucacgauguucccccacgugaucaucgacgugcggacccuggagcccguccugcuccccaugcccgacgugcgcuccacccuguuccacuucaaccagaaggacgagcccaagaugcggcugguggccaugcucuacacgccccugcgcagcaacggguccggcgacgacgucuucaccgugagcugccggauccugacccgcccgucccccgaguucgacuucaccuaccucgugccgcccaccgucgagagcaagacgaagcccuucacccugcccgugcugacccucggcgagcuguccaacagccgguucccccuguccaucgacgagauggugaccagccccaacgaguccaucgucgugcagccgcagaacgggcgcgugacgcucgacggcgagcugcuggggaccacccagcuccaggccugcaacaucugcagcauccggggcaaggucaccggccaggugcccaacgagcagcacauguggaaccuggagaucacgaaccugaacgggacccaguucgaccccaccgacgacgucccggcgccccucggcgugcccgacuucgccggggagguguucggcguccugucccagcgcaaccgcggggagagcaaccccgccaaccgggcccacgacgccgugguggccaccuacagcgacaaguacacgccgaagcugggccucguccagaucggcaccuggaacaccaacgacguggagaaccagcccaccaaguucacgcccaucgggcugaacgagguggcgaacggccaccgguucgagcaguggacccugccccgcuacuccggggcccucacccugaacaugaaccuggccccggccgucgcgccccucuuccccggcgagcggcugcuguucuuccgcagcuacgugccccucaagggcggguucggcaacccggccaucgacugccuggugccccaggaguggguccagcacuucuaccaggaguccgcccccagccugggggacguggcccucgugcgguacgucaaccccgacaccggccgcgugcuguucgaggccaagcugcacaagggcggguuccucacgguguccagcaccuccaccgggccggucguggugcccgcgaacggcuacuuccgguucgacagcugggucaaccaguucuacucccuggcccccaugggcaccgggaacggccgccgccgguuccaguga

SEQ ID NO: 11047 - RNA, 1617 nt, Artificial Sequence; identical to SEQ ID NO: 10608
  derived and/or modified sequence opt1 from major_capsid_protein__Norovirus__AJX18193

SEQ ID NO: 11048 - RNA, 1623 nt, Artificial Sequence; identical to SEQ ID NO: 9622
  derived and/or modified sequence opt1 from major_capsid_protein__Norovirus__AJZ77004

SEQ ID NO: 11049 - RNA, 1623 nt, Artificial Sequence; identical to SEQ ID NO: 9343
  derived and/or modified sequence opt1 from major_capsid_protein__Norovirus__AJZ77010

SEQ ID NO: 11050 - RNA, 1623 nt, Artificial Sequence
  derived and/or modified sequence opt1 from major_capsid_protein__Norovirus__AJZ77013
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcagcacccgcgggcacaaggccaccguguacacgggcuccgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgggcccucuga

SEQ ID NO: 11051 - RNA, 1623 nt, Artificial Sequence; identical to SEQ ID NO: 9353
  derived and/or modified sequence opt1 from major_capsid_protein__Norovirus__AJZ77015

SEQ ID NO: 11052 - RNA, 1623 nt, Artificial Sequence; identical to SEQ ID NO: 9351
  derived and/or modified sequence opt1 from major_capsid_protein__Norovirus__AJZ77019

SEQ ID NO: 11053 - RNA, 1623 nt, Artificial Sequence; identical to SEQ ID NO: 9445
  derived and/or modified sequence opt1 from major_capsid_protein__Norovirus__AJZ77022

SEQ ID NO: 11054 - RNA, 1623 nt, Artificial Sequence; identical to SEQ ID NO: 9717
  derived and/or modified sequence opt1 from major_capsid_protein__Norovirus__AJZ77027

SEQ ID NO: 11055 - RNA, 1623 nt, Artificial Sequence; identical to SEQ ID NO: 9499
  derived and/or modified sequence opt1 from major_capsid_protein__Norovirus__AJZ77030

SEQ ID NO: 11056 - RNA, 1623 nt, Artificial Sequence; identical to SEQ ID NO: 8842
  derived and/or modified sequence opt1 from major_capsid_protein__Norovirus__AJZ77033

SEQ ID NO: 11057 - RNA, 1623 nt, Artificial Sequence; identical to SEQ ID NO: 8842
  derived and/or modified sequence opt1 from major_capsid_protein__Norovirus__AJZ77036

SEQ ID NO: 11058 - RNA, 1623 nt, Artificial Sequence
  derived and/or modified sequence opt1 from major_capsid_protein__Norovirus__AKE31849
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccaggccacccggaccaacggcagcacgcgcgggcacaaggccaccguguacaccggcuccgccgacuucagccccaagcugggccggguccaguucgccaccgacacggacaacgacuucgagaccaaccagaacaccaaguucaccccggugggggugauccaggacggcuccacgacgccccgcaacgagccccagcaguggguccugcccagcuacuccgggcggaacauccacaacgugcaccucgccccggccguggcgcccaccuuccccggcgagcagcugcuguucuuccgcagcaccaugcccgggugcuccggcuacccgaacauggaccucgacugccugcugccccaggaguggguccaguacuucuaccaggaggccgcccccgcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgggcccucuga

SEQ ID NO: 11059 - RNA, 1623 nt, Artificial Sequence
  derived and/or modified sequence opt1 from major_capsid_protein__Norovirus__AKE31852
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgugggcggguucgagguccaggugauccucgccgggaacgccuucacggccggcaagaucaucuucgcggccgugccgcccaacuucccgaccgaggggcugucccccagccaggucaccauguucccccacaucaucguggacgugcggcagcuggagcccguccucaucccgcugcccgacgugcgcaacaacuuccaccacuacaaccaguccaacgaccccaccaucaagcugaucgccaugcucuacacgccccugcgggccaacaacgccggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgcguucgugguccagccccagaacgggcgcugcacgaccgacggcgugcuccuggggaccacccagcucucccccgugaacaucugcacguuccggggcgacgucacccacaucccgggcagccgcaacuacaccaugaaccuggccucccagaacuggaacagcuacgaccccaccgaggagauccccgcgccccuggggacgccggacuucgugggcaagauccagggggugcucacccagaccacccggacgaacggcagcacccgcgggcacaaggccaccgucuacaccggcuccgccgacuucagccccaagcugggccggauccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacacccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggccgcgccggcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacgcuggcgcccaugggcaacgggaccggccgccgccgggcccucuga

SEQ ID NO: 11060 - RNA, 1623 nt, Artificial Sequence
  derived and/or modified sequence opt1 from major_capsid_protein__Norovirus__AKE31855
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgugguccaggugauccucgccgggaacgccuucacggcgggcaagaucaucuucgccgccgugccgcccaacuucccgaccgaggggcugagccccucccaggucaccauguucccccacaucaucguggacgcccggcagcuggagcccgugcucaucccgcugcccgacguccgcaacaacuucuaccacuacaaccagagcaacgaccccaccaucaagcugaucgccaugcucuacacgccccugcgggcgaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccaccaagacggacggcagcacccgggggcacaaggccaccguguacaccggcuccgccgacuucagcccgaagcugggccgcguccaguucgccacggacaccgacaacgacuucgagaccaaccagaacaccaaguucacgcccgugggggugauccaggacggcuccaccacgccccggaacgagccccagcaguggguccugccgagcuacuccgggcgcaacacccacaacgugcaccucgcccccgccguggcgcccaccuuccccggcgagcagcugcuguucuuccggagcaccaugccggggugcuccggcuaccccaacauggaccucgacugccugcugccccaggaguggguccaguacuucuaccaggaggccgcccccgcccagagcgacguggcgcuccugcgcuucgugaacccggacaccggccggguccuguucgagugcaagcuccacaaguccggguacgugaccguggcccacaccggccagcacgaccuggucaucccgcccaacggguacuuccgcuucgacagcugggugaaccaguucuacacgcuggcccccaugggcaacgggaccggccggcgccgcgcccucuga

SEQ ID NO: 11061 - RNA, 1623 nt, Artificial Sequence
  derived and/or modified sequence opt1 from major_capsid_protein__Norovirus__AKE31858
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagacccagggggugcucacccagaccacgaagaccaacggcagcacccgggggcacaaggccaccguguacacgggcuccgccgacuucagcccgaagcugggccgcguccaguucgccaccgacaccgacaacgacuucgagaccaaccagaacacgaaguucacccccgugggggugauccaggacggcuccaccacgccccgggacgagccccagcaguggguccugccgagcuacuccgggcgcaacacccacaacgugcaccucgcccccgccguggcccccaccuuccccggcgagcagcugcuguucuuccggagcaccaugccggggugcuccggcuaccccaacauggaccucgaccgccugcugccccaggaguggguccaguacuucuaccaggagcccgcgccggcccagagcgacguggcccuccugcgguucgugaaccccgacaccggccgcguccuguucgagugcaagcuccacaaguccggguacgugaccguggcccacacgggccagcacgaccuggucaucccgcccaacggguacuuccgguucgacagcugggugaaccaguucuacacccuggcgcccaugggcaacgggaccggccgccgccgggcccucuga

SEQ ID NO: 11062 - RNA, 1623 nt, Artificial Sequence
  derived and/or modified sequence opt1 from major_capsid_protein__Norovirus__AKE31861
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgcccggcucuacacgccccugcgcgccaacaacgcgggcgacgacguguucaccguguccugccggguccugacccgcccgagccccgacuucgacuucaucuuccucgugccgcccaccguggagucccggacgaagcccuucagcguccccgugcugaccguggaggagaugaccaacucccgcuuccccaucccccuggagaagcuguucaccggcccgagcuccgccuucgucgugcagccccagaacgggcggugcacgaccgacggcguccuccuggggaccacccagcucagccccgugaacaucugcacguuccgcggcgacgugacccacaucuccggcagccggaacuacaccaugaaccuggccagccagaacuggaacuccuacgacccgaccgaggagauccccgcgccccuggggacgcccgacuucgucggcaagauccagggggugcucacccagaccaccaagacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacacccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguuccacacgcuggcccccaugggcaacgggaccggccgccgccgggcccucuga

SEQ ID NO: 11063 - RNA, 1623 nt, Artificial Sequence
  derived and/or modified sequence opt1 from major_capsid_protein__Norovirus__AKE31864
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacauccggacguuccgcggcgacgugacccacaucccgggcagccggaacuacaccaugaacuccgccagccagaacuggaacagcuacgaccccaccgaggagauccccgcgccccuggggacgccggacuucgucggcaagauccagggggugcugacccagaccacccgcgccaacggcuccacgcgggggcacaaggccaccguguacaccggcagcgccgacuucucccccaagcucggccgcguccaguucgccaccgacacggacaacgacuucgagaccaaccagaacaccaaguucacccccgugggggugauccaggacggcagcacgacgccccggaacgagccgcagcaguggguccugcccuccuacagcgggcgcaacauccacaacgugcaccuggcccccgccguggcgcccaccuucccgggcgagcagcuccuguucuuccgguccaccaugcccgggugcagcggcuaccccaacauggaccuggacugccuccugccccaggaguggguccaguacuucuaccaggaggccgccccggcccaguccgacguggcgcugcuccgcuucgugaaccccgacaccggccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacgggaccggccgccggcgcgcccuguga

SEQ ID NO: 11064 - RNA, 1623 nt, Artificial Sequence
  derived and/or modified sequence opt1 from major_capsid_protein__Norovirus__AKE31867
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccguguccaucccgcuccccgacguccgcaacaacuucuaccacuacaaccagagcaacgaccccaccaucaagcugaucgccaugcuguacacgccccuccgggccaacaacgcgggcgacgacguguucaccguguccugccgcguccugacccggccgagccccgacuucgacuucaucuuccuggugccgcccaccguggagucccgcacgaagcccuucagcguccccgugcucaccguggaggagaugaccaacucccgguuccccaucccccuggagaagcuguucaccggcccgagcuccgccuucgucgugcagccccagaacgggcgcugcacgaccgacggcguccuccuggggaccacccagcugagccccgugaacaucugcacguuccggggcgacgugacccacaucccgggcucccgcaacuacaccaugaaccucgccagccagaacuggaacagcuacgaccccaccgaggagauccccgcgccccuggggacgccggacuucgucggcaagauccagggggugcugacccagaccacccgggccaacggcuccacgcgcgggcacaaggccaccguguacaccggcagcgccgacuucucccccaagcucggccggguccaguucgccaccgacacggacaacgacuucgagaccaaccagaacaccaaguucacccccgugggggugauccaggacggcagcacgacgccccgcaacgagccgcagcaguggguccugcccuccuacagcgggcggaacauccacaacgugcaccuggcccccgccguggcgcccaccuucccgggcgagcagcuccuguucuuccgcuccaccaugcccgggugcagcggcuaccccaacauggaccuggacugccuccugccccaggaguggguccaguacuucuaccaggaggccgccccggcccaguccgacguggcgcugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacccuggcccccaugggcaacgggaccggccgccgccgggcccuguga

SEQ ID NO: 11065 - RNA, 1623 nt, Artificial Sequence
  derived and/or modified sequence opt1 from major_capsid_protein__Norovirus__AKE31870
augaagauggccagcuccgacgccaaccccagcgacggcuccaccgcgaaccuggugccggaggucaacaacgaggugauggcccucgagcccguggucggggccagcaucgccgcccccguggcgggccagcagaacgugaucgaccccuggauccgcaacaacuucguccaggcccccgggggcgaguucaccgugagcccccggaacgcccccggggagauccugugguccgcgccccugggcccggaccucaaccccuaccugccccaccuggcccgcauguacaacggcuacgccgggggcuucgaggugcaggucauccucgccgggaacgccuucacggccggcaagaucaucuucgcggccgugcccccgaacuuccccaccgaggggcugucccccagccaggugaccauguucccccacaucaucgucgacgugcggcagcuggagccggugcucaucccccugcccgacguccgcaacaacuucuaccacuacuaccaguccaacgaccccaccaucaagcugaucgccaugcucuacacgccgcugcgggccaacaacgccggcgacgacguguucaccgugagcugccgcguccugacccggcccucccccgacuucgacuucaucuuccucgugcccccgaccguggagagccgcacgaagcccuucuccguccccgugcugaccguggaggagaugaccaacagccgguuccccaucccgcuggagaagcuguucaccggccccuccagcgcguucgucgugcagccccagaacgggcgcugcacgaccgacggcguccuccuggggaccacccagcucuccccggugaacaucugcacguuccggggcgacgugacccacaucagcggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagucccagcaguggguccugccgagcuacuccgggcggaacacccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggccgcgcccgcccagagcgacguggcccuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacgcuggcgcccaugggcaacgggaccggccgccgccgggcccucuga

SEQ ID NO: 11066 - RNA, 1623 nt, Artificial Sequence
  derived and/or modified sequence opt1 from major_capsid_protein__Norovirus__AKE31873
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggaugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgggcccucuga

SEQ ID NO: 11067 - RNA, 1623 nt, Artificial Sequence
  derived and/or modified sequence opt1 from major_capsid_protein__Norovirus__AKE31876
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgcgcgacgacguguucaccgugagcugccggguccugacccgcccgucccccgacuucgacuucaucuuccucgugccgcccaccguggagagccggacgaagcccuucuccguccccgugcugaccguggaggagaugaccaacagccgcuuccccaucccccuggagaagcuguucaccggcccguccagcgccuucgucgugcagccccagaacggccggugcacgaccgacgggguccuccugggcaccacccagcucucccccgugaacaucugcacguuccgcggggacgugacccacaucagcggcucccggaacuacaccaugaaccuggccagccagaacuggaacagcuacgacccgaccgaggagauccccgcgccccugggcacgcccgacuucgucgggaagauccagggcgugcucacccagaccacccgcacggacggguccacccggggccacaaggccaccguguacaccgggagcgccgacuucuccccgaagcugggccgcguccaguucgccacggacaccgacaacgacuucgagaccaaccagaacaccaaguucacgcccgugggcgugauccaggacgggggcaccacccaccggaacgagccccagcaguggguccugcccaacuacagcgggcgcaacacccacaacgugcaccucgccccggccguggcccccacguuccccggcgagcagcugcuguucuuccgguccaccaugcccgggugcagcggcuacccgaacauggaccucgacugccugcugccccaggaguggguccaguacuucuaccaggaggcggcccccgcccaguccgacguggcccuccugcgcuucgugaaccccgacaccggccggguccuguucgagugcaagcuccacaagagcggguacgugaccguggcgcacaccggccagcacgaccuggucaucccgcccaacggguacuuccgcuucgacuccugggugaaccaguucuacacgcuggcccccaugggcaacgggaccggccgccggcgcgcccucuga

SEQ ID NO: 11068 - RNA, 1632 nt, Artificial Sequence
  derived and/or modified sequence opt1 from major_capsid_protein__Norovirus__AKF02368
augaagauggccagcaacgacgccgcgcccuccaacgacggcgccgccgggcuggugccggagaucaacaacgagaccauggcccucgagcccgucgccggcggggcgaucgccgcgccccugaccggccagacgaacuucaucgaccccuggauccgcgggaacuacgugcaggccccgaacggcgaguucaccgugagcccccggaacucccccggcgagauccugcucaaccuggagcuggggcccgagcucaacccguuccugagccaccugucccgcauguacaacggcuacgccgggggcaucgacguccaggugaucauggccgggaacgccuucaccgccggcaagaucaucuucgccgcgaucccgccccacuuccccguggagaaccucagcccgccccagaucaccauguucccccacaucaucgucgacgugcggacgcuggagcccaucaacauccccgugcccgacguccgcaacaacuucuuccacuacaaccagaacaacgagucccggaugcgccugguggccaugcucuacacgccccugcggagcaacggcuccgccgaggacguguucaccgucagcugccgcgugcugaccaagcccuccgccgacuucgaguucaacuaccucgugccgcccaccgucgagagccggaccaagcccuucaccauccccauccugaccaucggggagaugacgaacucccgcuucccggugcccaucgacaugcugcacaccagccccaccgagaacaucgugguccagccccagaacggccggugcaccaucgacggggagcuccugggcacgacccagcugaucaccuccaacaucugcagcuuccgcggcuccaucagcgggcacgagggcaacgacgaccagcaccucuggcacuucaacaucaccaacccgaacgggacgcccuucgaccccaccgaggacgugccggcgccccugggcacccccgacuuccgggggcagcuguacggcgugaucucccagcgcgaccgggagggcacccccagcgagaacaaccagaaggccaaccgcagccacgagggggucaucuccacgaucagcccgaaguucgugcccaagcucggcuccgugaugaucgggaccuggaccaccgacgacaucaagaaccagcccagcaaguucacgcccaucggccugaacgacgacgacaacuucaagcagugggagcugccgaacuacuccggggcccucacccugaacaugggccuggcccccagcgucuuccccaccuaccccggcgagcagguccucuucuuccgguccuaccugccgaugaagggcggguacgggagccccuucaucgacugccuggugccccaggaguggguggcccacuucuaccaggaguccgcccccgcgcagaccgacguggcccucauccgcuacgucaacccggagacgggccgggugcuguucgaggccaagcugcaccgccagggguucaucaccguggccaagagcggcgacucccccaucaacguccccgccaacggcuacuuccgguucgacagcugggugaaccaguucuacucccucgcgcccauggggaccggcaacgggcgccgccggauccaguga

SEQ ID NO: 11069 - RNA, 1644 nt, Artificial Sequence
  derived and/or modified sequence opt1 from major_capsid_protein__Norovirus__AKF42429
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgccaucgacuucaagggcaccgucuucgggguggccucccagcggaacaccacgggcaacagcaucggggccacccgcgcccacgaggugcacaucgacaccaccaacccccgguacacgccgaagcugggcagcguccugauguacuccgagagcaccgacuucgacgacgggcagcccacccgcuucacccccaucggcaugggcgcggacgacuggcaccagugggagcuccccgaguacuccgggcaccugacgcugagcaugucccucgccccggccguggcccccgcguuccccggcgagcggauccuguucuuccgcagcgugguccccuccgccgggggcuacgggagcggccacaucgacugccugaucccgcaggagugggugcagcacuucuaccaggaggccgcccccucccagagcgccguggcgcucauccgcuacgucaaccccgacaccggccggaacaucuucgaggccaagcugcaccgcgagggguucaucaccguggccaacuccggcaacaaccccaucguggucccgcccaacggguacuuccgguucgaggccugggugaaccaguucuacacccugacgcccaugggcaccgggcagggccgccggcgcgugcaguga

SEQ ID NO: 11070 - RNA, 1644 nt, Artificial Sequence
  derived and/or modified sequence opt1 from major_capsid_protein__Norovirus__AKF42434
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgccaucgacuucaagggcaccgucuucgggguggccucccagcggaacaccacgggcaacagcaucggggccacccgcgcccacgaggugcacaucgacaccaccaacccccgguacacgccgaagcugggcagcguccugauguacuccgagagcuccgacuucgacgacgggcagcccacccgcuucacccccaucggcaugggcgcggacgacuggcaccagugggagcuccccgaguacagcgggcaccugacccugaacaugaaccucgccccggccguggcccccgcguuccccggcgagcggauccuguucuuccgcuccgugguccccagcgccgggggcuacggguccggccacaucgacugccugaucccgcaggagugggugcagcacuucuaccaggaggccgcccccagccaguccgccguggcgcucauccgcuacgucaaccccgacacgggccggaacaucuucgaggccaagcugcaccgcgagggguucaucaccguggccaacagcggcaacaaccccaucguggucccgcccaacggguacuuccgguucgaggccugggugaaccaguucuacacccugacccccaugggcacggggcagggccgccggcgcgugcaguga

SEQ ID NO: 11071 - RNA, 1650 nt, Artificial Sequence
  derived and/or modified sequence opt1 from major_capsid_protein__Norovirus__AKF42437
augaagauggccagcaccgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccgugaagaacaucuccgccgcccagaucaccaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgagggcguggugguccagccccagaacggccgcugcacgcuggacgggacccuccagggcaccacccagcuggugccgacgcagaucugcgccuuccgggggaagcugaucggccagaccucccgcagccccgacuccgacagcaccgacuccgcgccccggcgccgggaccacccgcuccacguccagcuggagaaccuggacggcacccaguacgaccccacggacgaggugcccgccacccucggggccguggacuucaagggcaccaucuucggggucgccagccagcgcgacaccuccggcagccaggugggggccacgcgggcccacgaggugcacaucaacaccaccgacccccgcuacaccccgaagcugggcagcauccugauguacuccgagagccucgacuucgagacgggccagcccguccgguucacccccaucgggaugggcgagaacgacuggcaccagugggagcugcccgacuacuccgggcgccugacccucaacaugaaccuggccccggcgguggcccccgccuuccccggcgagcgcauccuguucuuccggagcaucgugcccuccgccgggggcuacggcagcgggcagaucgacugccucaucccgcaggaguggguccagcacuucuaccaggaggcggcccccucccagagcgccguggcccugauccgcuacgugaaccccgacaccggccggaacaucuucgaggccaagcugcaccgcgagggguucaucacggucgcgaacuccggcaacaaccccaucguggugccgcccaacggguacuuccgguucgaggccugggucaaccaguucuacacccucacccccaugggcaccggccaggggcgccggcgcaaccaguga

SEQ ID NO: 11072 - RNA, 1623 nt, Artificial Sequence; identical to SEQ ID NO: 9292
  derived and/or modified sequence opt1 from major_capsid_protein__Norovirus__ALA27427

SEQ ID NO: 11073 - RNA, 1623 nt, Artificial Sequence
  derived and/or modified sequence opt1 from major_capsid_protein__Norovirus__ALD09618
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgcccgcaacaccuucuuccacuacagcaaccagcccaacucccggaugcgccugguggccaugcucuacacgccccugcggagcaacggcuccggcgacgacgucuucaccgugagcugccgcgugcugacccggccgacccccgacuucgaguucaccuaccucgucccgcccuccguggagagcaagaccaagcccuucucccugcccauccugacgcucagcgagcugaccaacucccgcuuccccgugcccaucgacagccuguucaccgcgcagaacaacguccuccaggugcagugccagaacgggcggugcacccuggacggcgagcugcaggggacgacccagcuccugccguccggcaucugcgccuuccgcggccgggugaccgcccagaucaaccagcgcgaccgguggcacaugcagcugcagaaccucaacgggaccacguacgaccccaccgacgacguccccgccccgcugggcacccccgacuucaagggggugguguucggcauggucagccagcgcaacguggggaacgacgcccccggcuccacccgggcgcagcaggccugggucagcacguacagcccccaguucgugccgaagcugggcuccgugaaccuccgcaucagcgacaacgacgacuuccaguuccagcccaccaaguucacccccgucggggugaacgacgacgacgacggccaccccuuccggcagugggagcugccgaacuacuccggggagcugacccucaacaugaaccuggccccgcccguggcccccaacuuccccggcgagcagcuccuguucuuccgcagcuucguccccugcuccgggggcuacaaccagggcaucaucgacugccugaucccccaggaguggauccagcacuucuaccaggagagcgcccccucccagagcgacguggcgcugauccgguacgugaacccggacacggggcgcacccucuucgaggccaagcugcaccgcuccggcuacaucaccgucgcccacagcggggacuacccccugguggugcccgccaacggccacuuccgguucgacuccugggucaaccaguucuacagccucgcgcccauggggaccggcaacggccgccggcgcgcccaguga

SEQ ID NO: 11074 - RNA, 1623 nt, Artificial Sequence
  derived and/or modified sequence opt1 from major_capsid_protein__Norovirus__ALM96644
augaagauggccagcuccgacgccaaccccagcgacggcuccaccgcgaaccugauccccgaggugaacaacgaggucauggcccucgagcccguggugggggccgccaucgccgcgcccgucgccggccagcagaacgugaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacaucuucaccgucuccugccgcgugcugacccggcccagcccggacuucgacuucaucuuccucgugccgcccaccgucgagucccgcacgaagcccuucagcgugcccgugcugaccgucgaggagaugaccaacucccgguuccccaucccccuggagaagcuguucaccggccccagcuccgcccugguggugcagccgcagaacgggcgcugcacgaccgacggcguccugcucgggaccacccagcugagccccgugaacaucugcacguuccggggcgacgucacccacauccccggcucccgcaacuacaccaugaaccuggccagccagaacuggaacagcuacgacccgaccgaggagauccccgcgccccucgggacgcccgacuucgugggcaagauccagggggugcugacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcucccguccuacagcgggcggaacauccacaacgugcaccuggcccccgccgucgcccccaccuuccccggcgagcagcuccucuucuuccgcuccaccaugccggggugcagcggcuaccccaacauggaccuggacugccugcucccccaggagugggugcaguacuucuaccaggaggcggcccccgcccaguccgacguggcccugcugcgguucgucaacccggacaccggccgcguccucuucgagugcaagcugcacaagagcggguacgugaccguggcgcacaccggccagcacgaccuggugaucccgcccaacggguacuuccgguucgacuccugggugaaccaguucuacacccucgcccccaugggcaacgggacgggccgccgccgggcccuguga

SEQ ID NO: 11075 - RNA, 1623 nt, Artificial Sequence
  derived and/or modified sequence opt1 from major_capsid_protein__Norovirus__ALM96645
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcggcgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccgggcccagcuccgccuucgucgugcagccgcagaacggccgcugcacgaccgacgggguccuccugggcaccacccagcucagccccgugaacaucugcacguuccggggcgacgugacccacauccccgggucccgcaacuacaccaugaaccuggccagccagaacuggaacagcuacgacccgaccgaggagauccccgcgccccugggcacgcccgacuucgucgggaaggugcagggcgugcucacccagaccacccggacgaacggguccacccgcggccacaaggccaccgucuacaccggcagcgccgacuucuccccgaagcuggggcgggugcaguucgccacggacaccgacaacgacuucgagaccaaccagaacaccaaguucacgcccgugggcgucauccaggacgggagcaccacgccccgcaacgagccccagcagugggugcugccguccuacagcggccggaacauccacaacgugcaccucgcccccgccgucgcccccaccuuccccggggagcagcugcuguucuuccgcuccaccaugccgggcugcagcggcuaccccaacauggaccucgacugccugcugccccaggagugggugcaguacuucuaccaggaggcggcccccgcccaguccgacguggcccuccugcgguucgucaacccggacaccgugcgcgugcuguucgagugcaagcuccacaagagcggguacgucaccguggcgcacaccggccagcacgaccuggugaucccgcccaacggguacuuccgguucgacuccugggucaaccaguucuacacccuggcccccaugggcaacgggacgggccgccgccgggcccucuga

SEQ ID NO: 11076 - RNA, 1623 nt, Artificial Sequence
  derived and/or modified sequence opt1 from major_capsid_protein__Norovirus__ALM96646
augaagauggccagcaacgacgccaaccccuccgacggcagcgcggccaaccuggugcccaaggucaacaacgaggugauggcccucgagcccguggucggggccgccaucgcggcccccguggccggccagcagaacgugaucgaccccuggaucaagaacaacuucguccaggcccccgggggcaaguucaccgugucccccaagaacgcgcccggggagauccuguggagcgcgccccugggcccggaccucaaccccuaccugucccaccuggcccgcauguacaagggccacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 11077 - RNA, 1623 nt, Artificial Sequence
  derived and/or modified sequence opt1 from major_capsid_protein__Norovirus__ALM96647
augaagauggccagcaacgacgccaaccccuccgacggcagcgcggccaaccuggugccgaaggucaacaacgaggugauggcccucgagcccguggucggggccgccaucgcggcccccguggccggccagcagaacgugaucgaccccuggauccgcaacaacuucguccaggcccccgggggcaaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 11078 - RNA, 1623 nt, Artificial Sequence; identical to SEQ ID NO: 9820
  derived and/or modified sequence opt1 from major_capsid_protein__Norovirus__ALM98891

SEQ ID NO: 11079 - RNA, 1623 nt, Artificial Sequence; identical to SEQ ID NO: 9820
  derived and/or modified sequence opt1 from major_capsid_protein__Norovirus__ALM98892

SEQ ID NO: 11080 - RNA, 1623 nt, Artificial Sequence; identical to SEQ ID NO: 9820
  derived and/or modified sequence opt1 from major_capsid_protein__Norovirus__ALM98893

SEQ ID NO: 11081 - RNA, 1623 nt, Artificial Sequence; identical to SEQ ID NO: 9820
  derived and/or modified sequence opt1 from major_capsid_protein__Norovirus__ALM98894

SEQ ID NO: 11082 - RNA, 1623 nt, Artificial Sequence; identical to SEQ ID NO: 9820
  derived and/or modified sequence opt1 from major_capsid_protein__Norovirus__ALM98895

SEQ ID NO: 11083 - RNA, 1623 nt, Artificial Sequence; identical to SEQ ID NO: 9179
  derived and/or modified sequence opt1 from major_capsid_protein__Norovirus__ALM98896

SEQ ID NO: 11084 - RNA, 1623 nt, Artificial Sequence; identical to SEQ ID NO: 9820
  derived and/or modified sequence opt1 from major_capsid_protein__Norovirus__ALM98897

SEQ ID NO: 11085 - RNA, 1623 nt, Artificial Sequence; identical to SEQ ID NO: 9820
  derived and/or modified sequence opt1 from major_capsid_protein__Norovirus__ALM98899

SEQ ID NO: 11086 - RNA, 1623 nt, Artificial Sequence; identical to SEQ ID NO: 9497
  derived and/or modified sequence opt1 from major_capsid_protein__Norovirus__ALM98901

SEQ ID NO: 11087 - RNA, 1623 nt, Artificial Sequence
  derived and/or modified sequence opt1 from major_capsid_protein__Norovirus__ALM98907
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccagcuacuccggccgcaacaucccgaacguccaccucgcccccgcgguggcccccaccuuccccggggagcagcugcuguucuuccggagcaccaugccgggcugcuccggcuaccccaacauggaccucgacugccugcugccccaggagugggugcaguacuucuaccaggaggccgcccccgcgcagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcaccggccgccggcgcgcccucuga

SEQ ID NO: 11088 - RNA, 1623 nt, Artificial Sequence
  derived and/or modified sequence opt1 from major_capsid_protein__Norovirus__ALM98910
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggacgccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 11089 - RNA, 1623 nt, Artificial Sequence
  derived and/or modified sequence opt1 from major_capsid_protein__Norovirus__ALM98913
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccgaccgggacuucgaggccaaccagaacaccaaguucacccccgucggggugauccaggacggcgggacgacccaccgcaacgagccccagcagugggugcugcccagcuacuccggccggagcaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 11090 - RNA, 1623 nt, Artificial Sequence; identical to SEQ ID NO: 9688
  derived and/or modified sequence opt1 from major_capsid_protein__Norovirus__ALM98916

SEQ ID NO: 11091 - RNA, 1623 nt, Artificial Sequence
  derived and/or modified sequence opt1 from major_capsid_protein__Norovirus__ALT54478
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccgggccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccagcuacuccggccggaacaccccgaacguccaccucgcgcccgccguggcccccaccuuccccggggagcagcugcuguucuuccgcagcaccaugccgggcugcuccggcuaccccaacauggaccucgacugccugcugccccaggagugggugcaguacuucuaccaggaggccgcgcccgcccagagcgacgucgcccuccugcgguucgugaacccggacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccgccgggcgcucuga

SEQ ID NO: 11092 - RNA, 1617 nt, Artificial Sequence
  derived and/or modified sequence opt1 from major_capsid_protein__Norovirus__ALT54488
augaugauggccagcaaggacgcccccuccaacauggacggcaccagcggggcgggccagcuggugccggaggucaacgccgccgagccccucccccuggagcccguggugggggccgccaccgcggccgccacggccggccaggucaacaugaucgacccguggaucaugaacaacuucgugcaggcgcccgagggggaguucaccaucucccccaacaacacccccggcgacauccuguucgaccuccgccugggcccgcaccugaaccccuuccuccugcaccugagccagauguacaacgggugggugggcaacaugcggguccgcgugaugcucgccgggaacgccuucuccgccggcaagaucaucaucugcugcgugccgcccggguucgagagccagaacaucuccaucggccaggccaccauguucccccacgucaucgcggacgugcgggugcuggagcccaucgaggucccccuggacgacgugcgcaacguccucuuccacacgaacgagaaccggcccaccaugcgccugcugugcaugcucuacaccccgcugcgggccggcggggccagcuccggcaccgaccccuucgugaucgccgggcgcgugcugacgugccccgcccccgacuucaacuuccucuuccuggugccgcccagcgucgagcagaagacccggcagcugaccauccccaacaucccccucaacaaccuggcgaacucccgcgugccggccaugaucaacaagaugaccgugagcgccgaccagaaccaggucgugcaguuccagaacggccggugcacgcuggagggccagcuccuggggaccacccccguguccgccaaccaggucgcccgcauccggggcaagguguucagcaccaacuccgggacgggccugaaccucaccgaggucgacgggacccccuaccacgcguucgagagccccgccccgcugggcuuccccgacaucggcaacugcgacuggcacguguacgccuucaaggugaaccagaacaccggggaccccauguaccgccuggacaucacgcagggcaacuccuucgccccgcaccucgggagcaucgaguucuccagcgagaaccaccccagcggcgaccagcuggggacccugaccuggaucagcccccucaacaacgccucccgggucgaccccuggaagaucccgaccuacggcuccacgcugaccgagagcaccaaccuggcgccgcccaucuucccgcccggcuucggggaguccaucguguacuucaugagcgacuuccccaucguguccggcaacaccgcccagauccccugcacgcucccccaggaguucgucagcuccuucguggagcagcaggcccccauccgcggggaggccgcgcugcugcacuacguggaccccgacacccaccggaaccucggcgaguucaagcuguaccccgacggguucaucacgugcguccccaacaccggcggcgggccgcagaaccugcccagcaacggcguguucguguucuccagcugggucucccgcuacuaccagcucaagcccguggggaccaccggccccgugcggcgccugggcguccggcgcguguga

SEQ ID NO: 11093 - RNA, 1620 nt, Artificial Sequence
  derived and/or modified sequence opt1 from major_capsid_protein__Norovirus__ALT54491
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaaggacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccaacgccuucgugguccagccgcagaacgggcgcugcacgaccgacggcgugcuccuggggaccacccagcucagccccgucaacaucugcacguuccggggcgacgugacccagaucgccuccacccagaccuacacgaugaaccuggccagccugaacuggaacaacuacgaccccaccgaggagaucccggcgccccucggcgcccccgacuucauggggaagauccagggcgugcugacccagaccacgcgccagggcggguccacccgggggcacaaggccaccgucagcaccggcagcgugcacuucacgcccaagcugggcuccgugcgcuucgacaccgacaccaacaacgaccuccagccgcaccagagcacccgguucacgcccgucggggugauccaggacggcgacacccaccagaacgagccccagcagugggcccugcccugcuacuccgggcgcgacgugaacaacguccaccuggccccggcgguggcccccagcuuccccggcgagcagcuccuguucuuccgguccaccaugcccgggugcagcggcuacccgaacauggaccuggacugccuccugccccaggagugggugcagcacuucuaccaggaggccgcccccgcgcaguccgacgucgcccugcuccgcuucgugaaccccgacaccggccgggugcuguucgagugcaagcugcacaagagcggguacgucacgguggcccacaccggccagcacaaccucgugaucccgcccaacggguacuuccgcuucgacuccugggucaaccaguucuacacccuggcccccaugggcaacgggaccggccggcgccgcgugcuguga

SEQ ID NO: 11094 - RNA, 1620 nt, Artificial Sequence
  derived and/or modified sequence opt1 from major_capsid_protein__Norovirus__ALT54494
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaaggacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccaacgccuucgugguccagccgcagaacgggcgcugcacgaccgacggcgugcuccuggggaccacccagcucagccccgucaacaucugcacguuccggggcgacgugacccagaucgccuccacccagaccuacacgaugaaccuggccagccugaacuggaacaacuacgaccccaccgaggagaucccggcgccccucggcgcccccgacuucauggggaagauccagggcgugcugacccagaccacgcgccaggacggguccacccggggccacaaggccaccgucagcaccgggagcgugcacuucacgcccaagcugggcuccgugcgcuucgacaccgacaccaacaacaaccuccagccgcaccagagcacccgguucacgcccgucggcgugauccaggacggggacacccaccagaacgagccccagcagugggugcugcccugcuacuccggccgcgacgucaacaacgugcaccuggccccggccguggcgcccagcuuccccggggagcagcuccuguucuuccgguccaccaugcccggcugcagcggguacccgaacauggaccuggacugccuccugccccaggaguggguccagcacuucuaccaggaggccgcccccgcccaguccgacguggcgcugcuccgcuucgugaaccccgacaccggccggguccuguucgagugcaagcugcacaagagcggcuacgugacgguggcccacaccgggcagcacaaccucgucaucccgcccaacggcuacuuccgcuucgacuccugggugaaccaguucuacacccuggcccccauggggaacggcaccgggcggcgccgcgugcuguga

SEQ ID NO: 11095 - RNA, 1620 nt, Artificial Sequence
  derived and/or modified sequence opt1 from major_capsid_protein__Norovirus__BAM65003
augaugauggccagcaaggacgcccccuccaacauggacggcaccagcggggcgggccagcuggugccggaggucaacgccgccgagccccucccccuggagcccguggugggggccgccaccgcggccgccacggccggccaggucaaccugaucgacccguggaucaugaacaacuucgugcaggcgcccgagggggaguucaccaucucccccaacaacacccccggcgacauccucuucgaccugcagcugggcccgcaccucaaccccuuccugcagcaccugagccagauguacaacgggugggugggcaacaugcgcguccgggugaugcucgccgggaacgccuucaccgccggcaagaucaucaucugcugcgugccgcccggguucgccucccagaacaucagcaucggccaggcgacgauguucccccacgucaucgccgacgugcgcgugcuggagcccaucgagaucccccuggacgacguccggaacguccucuuccacaccaacgagaaccgccccaccaugcggcugcugugcaugcucuacaccccgcugcgcgccggcggggccuccagcggcacggaccccuucgugaucgccgggcgggugcugaccugccccucccccgacuucaacuuccucuuccuggugccgcccagcguggagcagaagacccgccagcugaccguccccaacaucccccucaacaaccuggcgaacucccgggugccggccaugaucaacaagaugacggugagcaccgaccagaaccaggucgugcaguuccagaacggccgcugcacccuggagggccagcuccuggggaccacgcccguguccgccagccaggucgcccggauccgcggcaagguguucuccaccgccagcgggaagggccugaaccucaccgagcuggacgggacccccuaccacgcguucgagucccccgccccgcugggcuuccccgacaucggcgccugcgacuggcacgucagcacguucaagguggaccagaaccucuccggggaccccaugagccggcuggacaucaagcagaacgccccguucgcgccccaccugggcagcaucgaguucaccuccgaccaggagcccaccggggaccagcucggcacccuggcgugggugagccccuccacgagcggggcccgcgucgacccguggaagauccccuccuacggcagcaccgugaccgaguccacccaccuggccccgcccaucuucccgcccggcuucggggaggccaucguguacuucaugagcgacuuccccaucgucuccggcaacacggcccaggugcccugcacccucccccaggaguucgugagccacuucgucgagcagcaggcccccauccgcggggaggccgcccugcugcacuacguggaccccgacacccaccggaaccucggcgaguucaagcuguaccccgacggguucaucacgugcgugccgaacaccggcggcgggccccagaaccugcccaucaacggcgucuucguguucuccagcugggugucccgguacuaccagcucaagcccgucgggaccgccggcccggcgcgccggcugggcgugcgccggguguga

SEQ ID NO: 11096 - RNA, 1647 nt, Artificial Sequence
  derived and/or modified sequence opt1 from major_capsid_protein__Norovirus__BAM65005
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcguccugacccgcagcaccucccgggcgagcgaccaggccgacacggccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcgcacgaggccaaggucgacaccaccagcgggcgcuucacgcccaagcucggcucccuggagaucagcaccgaguccggcgacuucgaccagaaccagccgacccgguucacccccguggggaucggcgucgacaacgaggccgacuuccagcaguggagccugcccgacuacuccgggcaguucacgcacaacaugaaccucgcccccgcgguggccccgaacuuccccggcgagcagcugcuguucuuccgcagccagcuccccuccagcgggggccgguccaacggcauccuggacugccuggugccccaggaguggguccagcacuucuaccaggagagcgccccggcccagacccagguggcccucgugcgcuacgucaaccccgacaccgggcgcgugcuguucgaggcgaagcugcacaagcucggcuucaugaccaucgccaaguccggggacagccccaucacggugcccccgaacggcuacuuccgguucgaguccugggucaaccccuucuacacccuggcccccauggggaccggcaacggccgccggcgcauccaguga

SEQ ID NO: 11097 - RNA, 1644 nt, Artificial Sequence
  derived and/or modified sequence opt1 from major_capsid_protein__Norovirus__BAM65007
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucaacaccacggacccccgcuacacccccaagcugggcagcauccugaugcacagcgaguccgacgacuucgugaccggccagccggugcgguucacccccaucgggaugggcgacaacgacuggcaccagugggagcuccccgacuacagcgggcaccugacgcugaacaugaaccucgcccccgcggucgccccggccuuccccggcgagcgcauccuguucuuccgcuccaucgugcccagcgccgggggcuacggcuccgggcagaucgacugccugaucccccaggagugggugcagcacuucuaccaggaggcggccccgagccaguccgccgucgcccucauccgguacgugaaccccgacaccggccgcaacaucuucgaggccaagcugcaccgggagggguucaucaccguggcgaacagcggcaacaaccccaucgucgugcccccgaacggguacuuccgcuucgaggccugggugaaccaguucuacacccugacgcccaugggcaccggccaggggcggcgccggaaccaguga

SEQ ID NO: 11098 - RNA, 1623 nt, Artificial Sequence; identical to SEQ ID NO: 8842
  derived and/or modified sequence opt1 from major_capsid_protein__Norovirus__CCX28604

SEQ ID NO: 11099 - RNA, 1623 nt, Artificial Sequence
  derived and/or modified sequence opt1 from major_capsid_protein__Norovirus__CCX28607
augaagauggccagcuccgacgccaaccccagcgacggcuccaccgcgaaccuggugcccgaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggugaccauguucccccacaucaucguggacguccggcagcuggagcccgugcucgugccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccgcaacuacaccaugaaccuggccucccagaacuggaacagcuacgacccgaccgaggagauccccgcgccccuggggacgcccgacuucgugggcaagauccaggggguccucacccagaccacccggacggacggcagcacccgcgggcacaaggccaccguguacaccggcuccgccgacuucagcccgaagcugggccgggugcaguucgccacggacaccgacaacgacuucgaggccaaccagaacaccaaguucacccccgucggggugauccaggacggcuccacggcccaccgcaacgagccccagcagugggugcugcccagcuacuccgggcggaacauccacaacguccaccucgcgccggccguggcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaagccgggguacgucacgguggcccacaccggccagcacgaccuggugaucccgcccaacggguacuuccgguucgacuccugggucaaccaguucuacacccuggcccccaugggcaacgggaccggccgccgccgggcgcucuga

SEQ ID NO: 11100 - RNA, 1623 nt, Artificial Sequence
  derived and/or modified sequence opt1 from major_capsid_protein__Norovirus__CCX28619
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucccgggcagccacaacuacaccaugaaccuggccucccagaacuggaacagcuacgaccccaccgaggagauccccgcgccccuggggacgccggacuucgugggcaagauccaggggguccucacccagaccacccgcacgaacggcagcacccgggggcacaaggccaccguguacaccggcuccgccgacuucagccccaagcugggccgcgugcaguucgccacggacaccgacaacgacuucgagaccaaccagaacaccaaguucacgcccgucggggugauccaggacggcuccaccacgccccggaacgagccgcagcagugggugcugcccagcuacuccgggcgcaacauccacaacguccaccucgcccccgccguggcccccaccuucccgggcgagcagcugcuguucuuccggagcaccaugcccgggugcuccggcuaccccaacauggaccucgacugccugcugccccaggagugggugcaguacuucuaccaggaggcggccccggcccagagcgacgucgcccuccugcgcuucgugaaccccgacaccggccgggugcuguucgagugcaagcuccacaaguccggguacgucaccguggcgcacaccggccagcacgaccuggugaucccgcccaacggguacuuccgcuucgacagcugggucaaccaguucuacacccuggcccccaugggcaacgggacgggccggcgccgcgcccucuga

SEQ ID NO: 11101 - RNA, 1623 nt, Artificial Sequence
  derived and/or modified sequence opt1 from major_capsid_protein__Norovirus__CCX28622
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccgcccagaacuggaacagcuacgacccgaccgaggagauccccgcgccccuggggacgcccgacuucgucggcaagauccagggggugcucacccagaccaccaagacgaacggcuccacccgggggcacaaggccaccguguacaccggcagcgccgacuucuccccgaagcugggccgcguccaguucgccacggacaccgacaacgacuucgagaccaaccagaacaccaaguucacgcccgugggggugauccaggacggcagcaccacgccccggaacgagccccagcaguggguccugccguccuacagcgggcgcaacacccacaacgugcaccucgcccccgccguggcgcccaccuuccccggcgagcagcugcuguucuuccgguccaccaugccggggugcagcggcuaccccaacauggaccucgacugccugcugccccaggaguggguccaguacuucuaccaggaggccgcccccgcccaguccgacguggcgcuccugcgcuucgugaacccggacaccggccggguccuguucgagugcaagcuccacaagagcggguacgugaccguggcccacaccggccagcacgaccuggucaucccgcccaacggguacuuccgcuucgacuccugggugaaccaguucuacacgcuggcccccaugggcaacgggaccggccggcgccgcgcccucuga

SEQ ID NO: 11102 - RNA, 1623 nt, Artificial Sequence; identical to SEQ ID NO: 11100
  derived and/or modified sequence opt1 from major_capsid_protein__Norovirus__CCX28625

SEQ ID NO: 11103 - RNA, 1623 nt, Artificial Sequence; identical to SEQ ID NO: 11101
  derived and/or modified sequence opt1 from major_capsid_protein__Norovirus__CCX28628

SEQ ID NO: 11104 - RNA, 1623 nt, Artificial Sequence; identical to SEQ ID NO: 8842
  derived and/or modified sequence opt1 from major_capsid_protein__Norovirus__CCX28631

SEQ ID NO: 11105 - RNA, 1623 nt, Artificial Sequence; identical to SEQ ID NO: 11100
  derived and/or modified sequence opt1 from major_capsid_protein__Norovirus__CCX28634

SEQ ID NO: 11106 - RNA, 1623 nt, Artificial Sequence
  derived and/or modified sequence opt1 from major_capsid_protein__Norovirus__CCX28637
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucuccguccccgugcugaccguggaggagaugaccaacagccgguuccccaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacaucagcggcagccgcaacuacaccaugaaccuggccucccagaacuggaacagcuacgaccccaccgaggagaucccggcgccccuggggacgcccgacuucgucggcaagauccagggggugcucacccagaccaccaagacgaacggcuccacccgggggcacaaggccaccguguacaccggcagcgccgacuucucccccaagcugggccgcguccaguucgccacggacaccgacaacgacuucgagaccaaccagaacaccaaguucacgccggugggggugauccaggacggcagcaccacgccccggaacgagccccagcaguggguccugcccuccuacagcgggcgcaacacccacaacgugcaccucgccccggccguggcccccaccuuccccggcgagcagcugcuguucuuccgguccaccaugcccgggugcagcggcuacccgaacauggaccucgacugccugcugccccaggaguggguccaguacuucuaccaggaggcggcccccgcccaguccgacguggcccuccugcgcuucgugaaccccgacaccggccggguccuguucgagugcaagcuccacaagagcggguacgugaccguggcgcacaccggccagcacgaccuggucaucccgcccaacggguacuuccgcuucgacuccugggugaaccaguucuacacgcuggcccccaugggcaacgggaccggccggcgccgcgcccucuga

SEQ ID NO: 11107 - RNA, 1623 nt, Artificial Sequence; identical to SEQ ID NO: 8842
  derived and/or modified sequence opt1 from major_capsid_protein__Norovirus__CCX28640

SEQ ID NO: 11108 - RNA, 1623 nt, Artificial Sequence; identical to SEQ ID NO: 11100
  derived and/or modified sequence opt1 from major_capsid_protein__Norovirus__CCX28643

SEQ ID NO: 11109 - RNA, 1623 nt, Artificial Sequence; identical to SEQ ID NO: 8842
  derived and/or modified sequence opt1 from major_capsid_protein__Norovirus__CCX28646

SEQ ID NO: 11110 - RNA, 1623 nt, Artificial Sequence; identical to SEQ ID NO: 9034
  derived and/or modified sequence opt1 from major_capsid_protein__Norovirus__CCX28649

SEQ ID NO: 11111 - RNA, 1623 nt, Artificial Sequence; identical to SEQ ID NO: 11101
  derived and/or modified sequence opt1 from major_capsid_protein__Norovirus__CCX28652

SEQ ID NO: 11112 - RNA, 1626 nt, Artificial Sequence; identical to SEQ ID NO: 9197
  derived and/or modified sequence opt1 from major_capsid_protein_VP1__Norovirus__AEE10000

SEQ ID NO: 11113 - RNA, 1626 nt, Artificial Sequence; identical to SEQ ID NO: 9200
  derived and/or modified sequence opt1 from major_capsid_protein_VP1__Norovirus__AEE10012

SEQ ID NO: 11114 - RNA, 1623 nt, Artificial Sequence; identical to SEQ ID NO: 9767
  derived and/or modified sequence opt1 from major_capsid_protein_VP1__Norovirus__AGJ52172

SEQ ID NO: 11115 - RNA, 1623 nt, Artificial Sequence; identical to SEQ ID NO: 9691
  derived and/or modified sequence opt1 from major_capsid_protein_VP1__Norovirus__AGJ52173

SEQ ID NO: 11116 - RNA, 1623 nt, Artificial Sequence; identical to SEQ ID NO: 9501
  derived and/or modified sequence opt1 from major_capsid_protein_VP1__Norovirus__AGJ52174

SEQ ID NO: 11117 - RNA, 1632 nt, Artificial Sequence; identical to SEQ ID NO: 9821
  derived and/or modified sequence opt1 from major_capsid_protein_VP1__Norovirus__AGJ52176

SEQ ID NO: 11118 - RNA, 1608 nt, Artificial Sequence
  derived and/or modified sequence opt1 from major_capsid_region__Norovirus__ADO85555
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagcccuggaugcggcucgucgccaugcuguacacgccccugcgcuccaacggcagcggcgacgacguguucaccguguccugccggguccucacccgccccagcccggacuucgacuucaacuaccuggugccgcccaccguggaguccaagacgaagcccuucacccugcccauccucaccaucggggagcugaccaacagccgguuccccguccccaucgacgagcuguacacgucccccaacgagagccucguggugcagccgcagaacggccgcugcgcccuggacggggagcugcagggcaccacccagcuccugcccaccgccaucugcuccuuccggggccgcaucaaccagaaggucagcggggagaaccacguguggaacaugcaggucacgaacaucaacggcacccccuucgacccgaccgaggacgugcccgcgccccuggggacccccgacuucuccggcaagcuguucggggugcucagccagcgggaccacgacaacgccugccgcucccacgacgccgucaucgccacgaacagcgccaaguucaccccgaagcugggcgcgauccagaucggcaccugggaggagaacgacgugcacaucaaccagcccaccaaguucacgcccgugggccucuucgagagcgagggguucaaccaguggacccugcccaacuacuccggggcccugacccucaacaugggccuggccccgcccgucgcccccaccuuccccggggagcagauccuguucuuccggagccacaucccgcucaagggcggcguggccgaccccgugaucgacugccugcugccccaggaguggauccagcaccucuaccaggaguccgcgcccagccagacggacgucgcccugauccgcaucaccaacccggacaccgggcgggugcuguucgaggccaagcuccaccgcuccggcuacaucaccguggccaacacggggagccggcccaucgucgugcccgcgaacggcuacuuccgcuucgacuccugggugaaccaguucuacagccuggcccccauggggaccggcaacggccggcgccgcguccaguga

SEQ ID NO: 11119 - RNA, 1626 nt, Artificial Sequence
  derived and/or modified sequence opt1 from majore_capsid_protein__Norovirus__AFO84035
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcgcgcucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgcgccggucuacggccugcucguggaccccagccugcccuccaacccccaguggcagaacgggcgcgugcacgucgacggcacccugcucggcacgaccccggugagcggguccugggucagcugcuucgccgccgaggccgccuacgaguaccaguccgaggugggcgagguggcgaccuucacccugaucgagcaggacgggagcgccuacguccccggcgaccgggccgcgccccugggguacccggacuacuccggccagcucgagaucgaggugcagacggagaccaccaagaccggcgacaagcugaaggugacgaccuucgacaugauccuggggcccaccaccaacgucgaccaggugcccuaccagggcaagguguacgccagccucacgaccgccagcucccuggaccuggucgacgggcgcgcccgggccgugccccgcagcguguacuccuuccaggacguccucccggaguacaacgacggccugcuggugccccucgccccgccccuggggcccuaccugcccggcgaggugcuccugcgguuccgcaccuacaugcggcagcuggacaccgcggacgccgccgcccagcccaucgacugcgcccucccccaggaguucaucagcugguucgcguccaacaacuucacgguccagagcgacgcccugcugauccgcuaccggaacacccugaccggccagcuccuguucgaggccaagcuguacuccgagggguacaucgccgugagcuacuccggcagcgggccgcucaccuuccccacggacggcuucuucgagguggucuccugggugccccgccuguuccagcuggccagcguggggucccucgucaccggccgcacccugaagcaguga

SEQ ID NO: 11120 - RNA, 1623 nt, Artificial Sequence
  derived and/or modified sequence opt1 from major_viral_capsid_protein__Norovirus__AFN09918
augaagauggccagcaacgacgccacccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgaccagccgcgacggcuccacccgggggcacaaggccaccgugagcacgggcagcgugcacuucaccccgaagcugggcuccguccaguucagcaccgacaccuccaacgacuucgagacggggcagaacacccgcuucacccccgugggcgugguccaggacgggagcaccacgcaccagaacgagccccagcagugggugcugcccaacuacuccggccgggacagccacaacgugcaccucgccccggccgucgcccccaccuuccccggggagcagcugcuguucuuccgcuccaccaugcccggcugcagcggcuacccgaacaugaaccucgacugccugcugccccaggagugggugcagcacuucuaccaggaguccgcccccgcgcagagcgacguggcccuccugcgguucgucaaccccgacaccgggcgcgugcuguucgagugcaagcuccacaagccgggcuacgugaccgucgcccacacggggcagcacgaccuggugaucccgcccaacggcuacuuccgguucgacuccugggugaaccaguucuacacccuggcccccauggggaacggcgcgggccgccggcgcgcccucuga

SEQ ID NO: 11121 - RNA, 1623 nt, Artificial Sequence; identical to SEQ ID NO: 9292
  derived and/or modified sequence opt1 from major_viral_capsid_protein__Norovirus__AFN09921

SEQ ID NO: 11122 - RNA, 1623 nt, Artificial Sequence
  derived and/or modified sequence opt1 from major_viral_capsid_protein__Norovirus__AFN09924
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaaggggaacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacaucaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 11123 - RNA, 1623 nt, Artificial Sequence; identical to SEQ ID NO: 9292
  derived and/or modified sequence opt1 from major_viral_capsid_protein__Norovirus__AFN09927

SEQ ID NO: 11124 - RNA, 1623 nt, Artificial Sequence
  derived and/or modified sequence opt1 from major_viral_capsid_protein__Norovirus__AFN09930
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaucaccaagggcgacggguccacccggggccacaaggccacgguguacaccggcggggcccccuucaccccgaagcugggcagcgugcaguucagcaccgacacggagaacgacuucgagacccaccagaacaccaaguucacccccgucggggugauccaggacggcuccacgacccaccgcaacgagccccagcagugggugcuccccagcuacuccgggcggaacguccacaacgugcaccuggccccggccguggcgcccaccuuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 11125 - RNA, 1623 nt, Artificial Sequence; identical to SEQ ID NO: 9292
  derived and/or modified sequence opt1 from major_viral_capsid_protein__Norovirus__AFN09933

SEQ ID NO: 11126 - RNA, 1623 nt, Artificial Sequence; identical to SEQ ID NO: 9292
  derived and/or modified sequence opt1 from major_viral_capsid_protein__Norovirus__AFN09936

SEQ ID NO: 11127 - RNA, 1623 nt, Artificial Sequence
  derived and/or modified sequence opt1 from major_viral_capsid_protein__Norovirus__AFN09939
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcggggcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 11128 - RNA, 1623 nt, Artificial Sequence; identical to SEQ ID NO: 9292
  derived and/or modified sequence opt1 from major_viral_capsid_protein__Norovirus__AFN09942

SEQ ID NO: 11129 - RNA, 1623 nt, Artificial Sequence
  derived and/or modified sequence opt1 from major_viral_capsid_protein__Norovirus__AFN09945
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccacaacuacaccaugaaccuggccagccugaacuggaacaacuacgaccccaccgaggagaucccggcgccccucgggacgcccgacuucgugggcaagauccaggggguccugacccagaccaccaagggcgacggguccacgcgcggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccggaacgagccccagcagugggugcuccccuccuacagcggcgggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 11130 - RNA, 1623 nt, Artificial Sequence
  derived and/or modified sequence opt1 from major_viral_capsid_protein__Norovirus__AFN09948
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugggccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccgggcccuccggcgccuucgugguccagccgcagaacgggcgcugcacgaccgacggcgugcugcugggcaccacccagcucagccccgucaacaucugcacguuccgcggggacgugacccacaucgccggcucccggaacuacaccaugaaccuggccagccugaacuggaacaacuacgaccccaccgaggagaucccggcgccccucgggacgcccgacuucgugggcaagauccaggggguccugacccagaccaccaagggcgacggcuccacgcgggggcacaaggccaccguguacaccggcggggcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccagcuacuccggccggaacguccacaacgugcaccuggccccggccguggcgcccaccuuccccggggagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggcuacuuccgguucgacagcugggugaaccaguucuacacccucgcccccauggggaacggcacggggcgccggcgcgcccuguga

SEQ ID NO: 11131 - RNA, 1623 nt, Artificial Sequence; identical to SEQ ID NO: 9292
  derived and/or modified sequence opt1 from major_viral_capsid_protein__Norovirus__AFN09951

SEQ ID NO: 11132 - RNA, 1623 nt, Artificial Sequence
  derived and/or modified sequence opt1 from major_viral_capsid_protein__Norovirus__AFN09954
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgaccucaucuuccuggugccgcccaccguggagagccgcaccaagcccuucacgguccccauccugaccguggaggagaugaccaacucccgguuccccaucccccucgagaagcuguucaccggccccagcggggccuucgugguccagccgcagaacggccgcugcacgaccgacggggugcugcucggcaccacccagcugucccccgucaacaucugcacguuccggggcgacgugacccacaucgccgggagccgcaacuacaccaugaaccuggccucccucaacuggaacaacuacgaccccaccgaggagaucccggcgccccugggcacgcccgacuucguggggaagauccagggcguccugacccagaccaccaagggggacggcagcacgcggggccacaaggccaccguguacaccgggggcgcccccuucaccccgaagcucggguccgugcaguucagcacggacaccgagaacgacuucgagacccaccagaacaccaaguucacgcccgucggcgugauccaggacgggagcaccacccaccgcaacgagccccagcagugggugcugcccuccuacagcggccggaacguccacaacgugcaccuggccccggccguggcgcccaccuuccccggcgagcagcuccuguucuuccgcuccacgaugcccgggugcagcggcuacccgaacauggaccuggacugccuccugccccaggaguggguccagcacuucuaccaggaggccgcccccgcccaguccgacguggcgcugcuccgguucgugaaccccgacaccgggcgcguccuguucgagugcaagcugcacaagagcggcuacgugaccguggcccacaccgggcagcacgaccucgucaucccgcccaacggcuacuuccgguucgacuccugggugaaccaguucuacacccuggcccccaugggcaacgggacgggccgccggcgcgcccuguga

SEQ ID NO: 11133 - RNA, 1623 nt, Artificial Sequence
  derived and/or modified sequence opt1 from major_viral_capsid_protein__Norovirus__AFN09957
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggggcgcccccuucaccccgaagcugggguccgugcaguucagcacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 11134 - RNA, 1623 nt, Artificial Sequence
  derived and/or modified sequence opt1 from major_viral_capsid_protein__Norovirus__AFN09960
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguuccgcggccggagcuccgcccucgugguccacccccagaacgggcgcugcaccacggacggcgugcugcucgggaccacccagcugagcccggucaacaucugcaccuuccggggcgacgugacgcacaucgccggcucccacaacuacaccaugaaccuggccagccucaacuggaacaacuacgaccccaccgaggagauccccgcgccgcuggggacccccgacuucgugggcaagauccaggggguccugacgcagaccaccaagggcgacggguccacccgcggccacaaggccacgguguacaccggcagcgcccccuucacccccaagcucgggagcgugcaguucuccaccgacacggagaacgacuucgagacccaccagaacaccaaguucaccccggucggcgugauccaggacgggagcacgacccaccggaacgagccccagcagugggugcugcccuccuacagcggcgggaacguccacaacgugcaccuggcccccgccguggcgccgaccuuccccggcgagcagcuccuguucuuccgcuccaccaugcccggcugcagcggguaccccaacauggaccuggacugccuccugccgcaggaguggguccagcacuucuaccaggaggccgcccccgcccaguccgacguggcgcugcuccgguucgugaaccccgacacgggccgcguccuguucgaguacaagcugcacaagagcgacuacgugaccguggcccacaccgggcagcacgaccucgucaucccgcccaacggcuacuuccgguucgacuccugggugaaccaguucuacacccuggccgccauggggaacggcaccggccgccggcgcgcccuguga

SEQ ID NO: 11135 - RNA, 1623 nt, Artificial Sequence
  derived and/or modified sequence opt1 from major_viral_capsid_protein__Norovirus__AFN09963
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccagcuucacccccaagcugggguccgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggcgccgaccuuccccggggagcagcuccucuucuuccgcagcacgaugcccggcugcuccggcuaccccaacauggaccuggacugccugcucccgcaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 11136 - RNA, 1623 nt, Artificial Sequence; identical to SEQ ID NO: 9292
  derived and/or modified sequence opt1 from major_viral_capsid_protein__Norovirus__AFN09966

SEQ ID NO: 11137 - RNA, 1623 nt, Artificial Sequence; identical to SEQ ID NO: 10106
  derived and/or modified sequence opt1 from major_viral_capsid_protein__Norovirus__AFN09969

SEQ ID NO: 11138 - RNA, 1623 nt, Artificial Sequence
  derived and/or modified sequence opt1 from major_viral_capsid_protein__Norovirus__AFN09972
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccagaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcgcuguga

SEQ ID NO: 11139 - RNA, 1593 nt, Artificial Sequence
  derived and/or modified sequence opt1 from major_viral_capsid_protein__Norovirus__AFN09975
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccgcgcuucgagucccggaccaagcccuucagcgugcccgugcucacggucgaggagaugaccaacucccgcuuccccaucccgcuggagaagcuguucaccggccccagcuccgccuucguggugcagccccagaacgggcggugcaccacggacggcguccuccuggggaccacccagcugagccccgugaacaucugcaccuuccgcggcgacgucacgcacaucccgggcucccggaacuacaccaugaaccucgccagccagaacuggaacagcuacgggcccaccgaggagauccccgccccgcugggcacccccgacuucguggggaagauccagggcgugcugacgcagaccacccgcaccaacggguccacgcggggccacaaggccaccgucuacaccggcagcgcggacuucucccccaagcucgggcgcgugcaguucgccaccgacacggacaacgacuucgagaccaaccagaacaccaaguucacccccgugggcgucauccaggacgggagcacgaccccgcggaacgagccccagcagugggugcugcccuccuacagcggccgcaacauccacaacgugcaccuggcccccgccgucgccccgaccuuccccggggagcagcuccuguucuuccgguccaccaugcccggcugcagcggcuaccccaacauggaccuggacugccuccugccgcaggagugggugcaguacuucuaccaggaggcggcccccgcccaguccgacguggcccugcuccgcuucgucaaccccgacacggggcgggugcuguucgagugcaagcugcacaagagcggcuacgugaccgucgcgcacaccgggcagcacgaccucgugaucccgcccaacggcuacuuccgcuucgacuccugggugaaccaguucuacacccuggcccccauggggaacggcaccggccgccggcgcgcccuguga

SEQ ID NO: 11140 - RNA, 1623 nt, Artificial Sequence
  derived and/or modified sequence opt1 from major_viral_capsid_protein__Norovirus__AFN09978
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggccccgugcggggaguucaccgugagcccccggaacgcccccggcgagauccugugguccgcgccccuggggccggaccucaaccccuaccugagccaccuggcccgcauguacaacggcuacgccggcggguucgaggugcaggucauccucgccggcaacgccuucacggcggggaagaucaucuucgccgccgugccgcccaacuuccccaccgagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggggacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacggccgcugcacgaccgacgggguccuccugggcaccacccagcucagccccgugaacaucugcacguuccgcggggacgugacccacauccccggcucccggaacuacaccaugaaccuggccagccagaacuggaacagcuacgacccgaccgaggagauccccgcgccccugggcacgcccgacuucgucgggaagauccagggcgugcucacccagaccacccggacgaacggguccacccgcggccacaaggccaccguguacaccgggagcgccgacuucuccccgaagcugggccggguccaguucgccacggacaccgacaacgacuucgagaccaaccagaacaccaaguucacgcccgugggcgugauccaggacgggagcaccacgccccgcaacgagccccagcaguggguccugccguccuacagcggccggaacauccacaacgugcaccucgcccccgccguggcccccaccuuccccggggagcagcugcuguucuuccgcuccaccaugccgggcugcagcggguaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcacggggcgccgccgggcccucuga

SEQ ID NO: 11141 - RNA, 1623 nt, Artificial Sequence
  derived and/or modified sequence opt1 from major_viral_capsid_protein__Norovirus__AFN09981
augaagauggccagcaacgacgugaaccccuccgacggcagcgccgcgaaccugguccccgaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccggcucccgcaacuacaccaugaaccuggccagccugaacuggaacaacuacgaccccaccgaggagaucccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccgcaacgagccccagcaguggguccuccccagcuacuccgggcgggacgugccgaacgugcaccuggcccccgccgucgcccccaccuuccccggcgagcagcuccucuucuuccgcagcacgaugccgggcugcuccggguaccccaacauggaccuggacugccugcucccccaggagugggugcagcacuucuaccaggaggcggcccccgcccagagcgacguggcccugcugcgguucgucaacccggacaccggccgcguccucuucgagugcaagcugcacaaguccggguacgugaccguggcgcacaccggccagcacgaccuggugaucccgcccaacggguacuuccgguucgacagcugggugaaccaguucuacacccucgcccccaugggcaacggcacggggcgccggcgcgcccuguga

SEQ ID NO: 11142 - RNA, 1623 nt, Artificial Sequence
  derived and/or modified sequence opt1 from major_viral_capsid_protein__Norovirus__AFN09984
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcgucauguucgagugcaagcugcacaagagcggguacgugaccguggcgcacaccggccagcacgaccucgucaucccgcccaacggguacuuccgguucgacuccugggugaaccaguucuacacccuggcccccaugggcaacgggacgggccgccgccgggcccuguga

SEQ ID NO: 11143 - RNA, 1623 nt, Artificial Sequence; identical to SEQ ID NO: 8882
  derived and/or modified sequence opt1 from major_viral_capsid_protein__Norovirus__AFN09987

SEQ ID NO: 11144 - RNA, 1623 nt, Artificial Sequence; identical to SEQ ID NO: 8882
  derived and/or modified sequence opt1 from major_viral_capsid_protein__Norovirus__AFN09990

SEQ ID NO: 11145 - RNA, 1623 nt, Artificial Sequence
  derived and/or modified sequence opt1 from major_viral_capsid_protein__Norovirus__AFN09993
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgaccgcugcacgaccgacgggguccuccugggcaccacccagcucucccccgugaacaucugcacguuccgcggggacgugacccacaucccgggcagccggaacuacaccaugaaccuggccucccagaacuggaacagcuacgaccccaccgaggagauccccgcgccccugggcacgccggacuucgucgggaagauccagggcgugcucacccagaccacccggacgaacgggagcacccgcggccacaaggccaccguguacaccggguccgccgacuucagccccaagcugggccggguccaguucgccacggacaccgacaacgacuucgagaccaaccagaacaccaaguucacgcccgugggcgugauccaggacggguccaccacgccccgcaacgagccgcagcaguggguccugcccagcuacuccggccggaacauccacagcgugcaccucgcccccgccguggcccccaccuucccgggggagcagcugcuguucuuccgcuccaccaugcccggcugcagcggguaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcacggggcgccgccgggcccucuga

SEQ ID NO: 11146 - RNA, 1623 nt, Artificial Sequence; identical to SEQ ID NO: 8882
  derived and/or modified sequence opt1 from major_viral_capsid_protein__Norovirus__AFN09996

SEQ ID NO: 11147 - RNA, 1623 nt, Artificial Sequence; identical to SEQ ID NO: 10106
  derived and/or modified sequence opt1 from major_viral_capsid_protein__Norovirus__AFN09999

SEQ ID NO: 11148 - RNA, 1623 nt, Artificial Sequence
  derived and/or modified sequence opt1 from major_viral_capsid_protein__Norovirus__AGC96529
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccgggacaucccgaacgugcaccuggcccccgccgucgcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacguggcgcugcugcgguucgucaacccggacaccgggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgccggcgcgcccuguga

SEQ ID NO: 11149 - RNA, 1623 nt, Artificial Sequence
  derived and/or modified sequence opt1 from major_viral_capsid_protein__Norovirus__AGC96532
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagacgcccgcgccccuggggacccccgacuucgucggcaagauccagggggugcucacccagaccacgcggaccaacggcuccacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgggcccucuga

SEQ ID NO: 11150 - RNA, 1644 nt, Artificial Sequence
  derived and/or modified sequence opt1 from major_viral_capsid_protein__Norovirus__AGC96535
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgcgaucgacuucaagggcaccgucuucgggguggccucccagcggaacaccacgggcagcagcgugggggccacccgcgcccacgagguccacaucgacaccaccaacccccgguacacgccgaagcugggcuccgugcugaugcacagcgaguccagcgacuucgacgacgggcagcccacccgcuucacccccaucggcaugggcgccgacgacuggcaccagugggagcuccccgaguacuccgggcaccugacccugaacaugaaccucgcgccggccguggcccccgccuuccccggcgagcggauccuguucuuccgcagcgucgugcccuccgccgggggcuacgggagcggccagaucgacugccugaucccgcaggagugggugcagcacuucuaccaggaggccgcccccucccagagcgccgucgcccucauccgcuacgugaaccccgacacgggccggaacaucuucgaggcgaagcugcaccgcgagggguucaucaccguggccaacuccggcaacaaccccaucgucgugccgcccaacggguacuuccgguucgaggccugggugaaccaguucuacacccugacccccaugggcacggggcagggccgccggcgcguccaguga

SEQ ID NO: 11151 - RNA, 1623 nt, Artificial Sequence
  derived and/or modified sequence opt1 from major_viral_capsid_protein__Norovirus__AGS16690
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccaacuacagcggguccgacgucccgaacgugcaccuggcccccgccguggcgcccaacuuccccggcgagcagcuccucuucuuccggagcaccaugccgggcugcuccggguaccccaacauggaccuggacugccugcucccccaggaguggguccagcacuucuaccaggaggccgcccccgcccagagcgacguggcgcugcugcgcuucgugaacccggacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgggcccuguga

SEQ ID NO: 11152 - RNA, 1623 nt, Artificial Sequence; identical to SEQ ID NO: 11151
  derived and/or modified sequence opt1 from major_viral_capsid_protein__Norovirus__AGS16693

SEQ ID NO: 11153 - RNA, 1623 nt, Artificial Sequence; identical to SEQ ID NO: 9820
  derived and/or modified sequence opt1 from major_viral_capsid_protein__Norovirus__ALM98919

SEQ ID NO: 11154 - RNA, 1623 nt, Artificial Sequence; identical to SEQ ID NO: 9820
  derived and/or modified sequence opt1 from major_viral_capsid_protein__Norovirus__ALM98922

SEQ ID NO: 11155 - RNA, 1623 nt, Artificial Sequence; identical to SEQ ID NO: 9820
  derived and/or modified sequence opt1 from major_viral_capsid_protein__Norovirus__ALM98928

SEQ ID NO: 11156 - RNA, 1623 nt, Artificial Sequence; identical to SEQ ID NO: 9820
  derived and/or modified sequence opt1 from major_viral_capsid_protein__Norovirus__ALM98931

SEQ ID NO: 11157 - RNA, 1623 nt, Artificial Sequence; identical to SEQ ID NO: 9179
  derived and/or modified sequence opt1 from major_viral_capsid_protein__Norovirus__ALM98934

SEQ ID NO: 11158 - RNA, 1623 nt, Artificial Sequence
  derived and/or modified sequence opt1 from major_viral_capsid_protein__Norovirus__ALM98940
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucguggacugccugaucccccaggaguggauccagcacuucuaccaggagagcgcccccucccagagcgacgucgcccugauccgguacgugaacccggacacggggcgcacccucuucgaggcgaagcugcaccgcuccggcuacaucaccguggcccacagcggggacuacccccuggucgugcccgccaacggccacuuccgguucgacuccugggugaaccaguucuacagccucgcccccauggggaccggcaacggccgccggcgcgcgcaguga

SEQ ID NO: 11159 - RNA, 1623 nt, Artificial Sequence; identical to SEQ ID NO: 9820
  derived and/or modified sequence opt1 from major_viral_capsid_protein__Norovirus__ALM98943

SEQ ID NO: 11160 - RNA, 1623 nt, Artificial Sequence
  derived and/or modified sequence opt1 from putative_capsid_protein__Norovirus__ABD73936
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacgucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgaggacguguucaccgucuccugccgcgugcugacccggccgagccccgacuucgacuucaucuuccucgugccgcccaccgucgagucccgcacgaagcccuucaccgugcccauccugaccguggaggagaugaccaacagccgguuccccaucccccuggagaagcuguucacgggcccguccggggccuucgucgugcagccccagaacggccgcugcaccaccgacgggguccuccugggcaccacgcagcucagccccgugaacaucugcaccuuccggggcgacgugacccacaucgccgggacccacaacuacacgaugaaccuggccucccagaacuggaacaacuacgacccgaccgaggagauccccgcgccccugggcacccccgacuucgucgggcgcauccagggcaugcucacccagacgacccgcggggacggcagcacccggggccacaaggccaccguguccacgggggacgugcacuucaccccgaagcugggcagcauccaguucaacaccgacaccaacaacgacuucgagacggggcagaacaccaaguucacccccgucggcguggugcaggacgggaacggcacccaccagaacgagccccagcaguggguccugcccuccuacagcggccggacggggcacaacgugcaccucgccccggccguggcccccaccuuccccggcgagcagcugcuguucuuccgcagcaccaugcccgggugcuccggcuacccgaacaugaaccucgacugccugcugccccaggaguggguccagcacuucuaccaggaggccgcgcccgcccagagcgacguggcccuccugcgguucgugaaccccgacaccgggcgcguccuguucgagugcaagcuccacaaguccggcuacgugaccguggcccacacgggccagcacgaccuggucaucccgcccaacggguacuuccgguucgacagcugggugaaccaguucuacacccuggcgcccaugggcaacgggaccggccgccggcgcgcccucuga

SEQ ID NO: 11161 - RNA, 1560 nt, Artificial Sequence
  derived and/or modified sequence opt1 from structural_capsid_protein__Norovirus__ABY67257
augaagaugaccgacaaggacacccaggaggccgcccccgcgcugggccaggugcucccgcccgaggucgagguggccauccccguggagcccacggccggggcccagaucgccgcgccgaccgccggccaggucaaccccaucgaccccuggaucuucgccaacuucgugcaggcgccccagggggaguucaccaucagcccgaacaacaaccccggcgaggugcuguucgagcuggagcucgggcccgagcugaaccccuaccuggcccaccuccgccagauguacaacggcuggaccggcuccauccgggucaaggugauccuggccgggaacgccuucagcgccggcaagaucaucguguucugcaucccgcccggguucgacgccuccuaccugacgcccuuccaggcgacccaguucccccacgucaucauggacgugcgcgccgccgagccgaucgagaucccccucgccgacgugcggaacguccuguuccaccagggccccgacagccgcaugcggcugauggggaugcucuacacgccccugcgcgccaacuccggcgcggacccguucguggugaccggccggguccugaccugccccagccccgacuucuccuucuucuuccucgugcccccgaccguggaggagcgcagcacccccuucuccguccccaacgugcccguguacagccugaccaacucccgggccccgguccccaucuacgagcugcgcagcucccggagccucccccugacggugcaguuccagaacgggcgcugcaccguggagggcgaccugcucgggaccaccccguucuccgccggcgaccugugcagcuucaugugcauccggggcgacacgcagcacaucgccgagcugcucgagcccgacgaguccgccuucgucgugggggagcgccccgcgacccugggcuuccccgacuucagccagugcguccugcaccuccugcuggccgacgggaccggcaucuggcaccagucccucgacgugaagaacccgcagcacuucacccccgccaucggccaggugguccugagcggggacgugccccugacgcggacccgcgugcggcucgacuacguccugagcaccucccgcgacagcuucugggugcugcccgacuaccgguccgacgugcucggcagcgaguucgccccggccgucuccgcgcccggggugggcgagacccugcuguucuucauggggcgcgcccccgugcagggccccagcaacccgcuccccugccugcugccccucgagugggucuuccacuucgccuccgagcggcccacgaagcagagcgacguggcccugcugaacuacgugaacccggacaccgggcgcguccucuucgaggcgaagcuguacuccagcggcuuccugaccgugaaccucggcaccgccaacgaggugguccugcccacguccgggaucuucaaguucgccagcugggugucccuguacuaccagcugcgccccgugggcacccucagcgccgggcggcgccugccccgggucgacggcuacuga

SEQ ID NO: 11162 - RNA, 1653 nt, Artificial Sequence
  derived and/or modified sequence opt1 from viral_capsid_protein__Norovirus__AHA91656
augaugauggccagcaaggacgccaccuccaacauggacggcaccagcggggcgggccagcuggugcccgagaacaacaacacguccgagccgaucaacauggagcccgucgccggggccgugaccgccgccgcgaccgccggccaggugaacaugaucgaccccuggaucaugaacaacuacguccaggcgccccagggggaguucaccaucagcccgaacaacacgcccggcgacauccucuucgaccugcagcugggcccccaccucaaccccuuccuggcccaccugucccagauguacaacgggugggugggcaacaugaaggugcgcgucgugcucgccgggaacgccuucagcgccggcaagaucaucgugugcugcaucccgcccggguucuccgcccccaacaucagcaucgcccaggcgaccauguucccccacgucaucgccgacgugcgggugcuggagccgaucgacaucccccuggacgacguccgcaacgugcuguuccacaacaacgacaacggcaaccagaccaugcggcugcugugcaugcucuacacgccccugcgcuccggcgggaccagcuccggcaccgaccccuucgugaucgccgggcggguccugaccugcccgacccccgacuucaacuuccucuuccuggugccgcccacgguggagcagaagaccaagcaguucagcguccccaaccugccccucaacgugauguccaacagccgcgugcccucccugcugaacgccauggucgugagccccgaccaggcccaggugguccaguuccagaacggccggugcacccucgacggccagaugcuggggaccacgaccguguccgcgagcugcgucgcccgcuuccggggcaagaccuuccaggccccggacaaccgccuggggaucaaccucgccgagaucuccggcgagcccuaccacgccuucgagagccccgcgccccugggguucccggacuucggcgacggcgacuggcacgugaccgccacgaaggugacccccagccagcuggaggccaacgaccccgucgugauggggaacgugcagccguacaacccccaguucgcgccccaccucggcacccuggucguggagaaccccaccccggacaacgugacgaccgggaccgaccuccucuucaacaucaccuggcuguccaaccgggccaacaaccgcuucaaccccugggucauccccaacuacggcagcacgcugaccgaggccgcccagcucgcccccuccaucuucccgcccggguucggcgagaccaucguguacuucaacagcaccuuccccgccgugggcgcgacgacccacgccgccauccccugccugcugccgcaggaguucgucgcccacuucgugaacgagcaggcccccauccgcggggaggcggcccuccugcacuacaucgaccccgacacccaccggaaccugggcgaguucaagaucuaccccgagggguucgugaccugcgucccgaacgugggcgggacgggcccccagucccuccccaccaacggcaucuucguguucgucagcugggugucccgguacuaccagcugaagcccguggggaccgccggccaggcccgccggcugggguuccgccgggucuga

SEQ ID NO: 11163 - RNA, 1629 nt, Artificial Sequence; identical to SEQ ID NO: 9227
  derived and/or modified sequence opt1 from VP1_capsid_protein__Norovirus__BAL60747

SEQ ID NO: 11164 - RNA, 1629 nt, Artificial Sequence; identical to SEQ ID NO: 9228
  derived and/or modified sequence opt1 from VP1_capsid_protein__Norovirus__BAL60751

SEQ ID NO: 11165 - RNA, 1629 nt, Artificial Sequence; identical to SEQ ID NO: 9235
  derived and/or modified sequence opt1 from VP1_capsid_protein__Norovirus__BAL60763

SEQ ID NO: 11166 - RNA, 1629 nt, Artificial Sequence; identical to SEQ ID NO: 9238
  derived and/or modified sequence opt1 from VP1_capsid_protein__Norovirus__BAL60765

SEQ ID NO: 11167 - RNA, 1629 nt, Artificial Sequence; identical to SEQ ID NO: 9249
  derived and/or modified sequence opt1 from VP1_capsid_protein__Norovirus__BAL60787

SEQ ID NO: 11168 - RNA, 1629 nt, Artificial Sequence; identical to SEQ ID NO: 9250
  derived and/or modified sequence opt1 from VP1_capsid_protein__Norovirus__BAL60789

SEQ ID NO: 11169 - RNA, 1629 nt, Artificial Sequence; identical to SEQ ID NO: 9261
  derived and/or modified sequence opt1 from VP1_capsid_protein__Norovirus__BAL60807

SEQ ID NO: 11170 - RNA, 390 nt, Artificial Sequence
  derived and/or modified sequence opt1 from capsid__Norovirus__ACL14997
auggccagcaacgacgccgcgcccuccaacgacggcgccgccgggcuggugcccgagagcaacaacgaggucauggcccucgagcccguggccggcgcgucccuggccgcccccgugaccgggcagaccaacaucaucgaccccuggauccgcaugaacuucguccaggccccgaacggcgaguucacggugagcccccggaacucccccggggaggugcugcucaaccuggagcugggccccgagcucaacccguaccuggcgcaccugagccgcauguacaacggcuacgccgggggcauggagguccagaucaugcucgccgggaacgccuucaccgccggcaagcugaucuucgcggccgugccgcccuacaaccggcgcugcuga

SEQ ID NO: 11171 - RNA, 561 nt, Artificial Sequence
  derived and/or modified sequence opt1 from truncated_capsid_protein__Norovirus__ACB56490
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugaugcagcuggagcccgugcucaucccgcugcccgacguccggaacaacuucuaccacuacaaccagagcaacgacuccaccaucaaguucgacagcaacgccguguacaccacguga

SEQ ID NO: 11172 - RNA, 627 nt, Artificial Sequence
  derived and/or modified sequence opt1 from truncated_capsid_protein__Norovirus__ACF77106
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccaucuccuga

SEQ ID NO: 11173 - RNA, 627 nt, Artificial Sequence
  derived and/or modified sequence opt1 from truncated_capsid_protein__Norovirus__ACF77107
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccguga

SEQ ID NO: 11174 - RNA, 66 nt, Artificial Sequence
  derived and/or modified sequence opt1 from truncated_capsid_protein__Norovirus__ACU28807
augaagauggccagcaacgacgcccaccccuccgacggcagcgcggccaccuccagccagcgcuga

SEQ ID NO: 11175 - RNA, 312 nt, Artificial Sequence
  derived and/or modified sequence opt1 from truncated_capsid_protein__Norovirus__ACU28808
augaagauggccagcaacgacgccaaccccuccgacggcagcgccgccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccugggcccggaccucaaccccuaccugucccaccuggcccgcauguacaacggcuacgccgggggccucuga

SEQ ID NO: 11176 - RNA, 123 nt, Artificial Sequence
  derived and/or modified sequence opt1 from truncated_capsid_protein__Norovirus__ACV03476
augaagauggccagcaugacccccacccaccugaugggcccgcagcccacguccagccagcgcuccaccaugcggcucuggcuguggagcccccuguccgugccccuccugcgccggcuguga

SEQ ID NO: 11177 - RNA, 87 nt, Artificial Sequence
  derived and/or modified sequence opt1 from truncated_capsid_protein__Norovirus__ACV03479
augaagauggccagcaugaccccccugcaccucaugauggugccgcccgccuccagccagcgcuccaccaugcggcaguggcgcuga

SEQ ID NO: 11178 - RNA, 1623 nt, Artificial Sequence
  derived and/or modified sequence opt1 from capsid_protein__Norovirus__AFN70960.1
augaagauggccagcaaggacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgaggacgucuucaccguguccugccgcgugcugacccggccgagccccgacuucgacuucaucuuccucgucccgcccaccguggagucccgcacgaagcccuucaccgugcccauccugaccgucgaggagaugaccaacagccgguuccccaucccccuggagaagcuguucacgggcccguccggggccuucgugguccagccccagaacggccgcugcaccaccgacggggugcuccugggcaccacgcagcucagccccgugaacaucugcaccuuccggggcgacgucacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccguguccacgggggacguccacuucaccccgaagcugggcagcauccaguucaacaccgacaccaacaacgacuucgagacggggcagaacaccaaguucacccccgugggcgugguccaggacgggaacggcacccaccagaacgagccccagcagugggugcugcccuccuacagcggccggacggggcacaacgugcaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacguggcccuccugcgguucgucaaccccgacaccgggcgcgugcuguucgagugcaagcuccacaaguccggcuacgugaccgucgcccacacgggccagcacgaccuggugaucccgcccaacggguacuuccgguucgacagcugggugaaccaguucuacacccuggcgccccucggcaacgggaccggccgccggcgcgcccuguga

SEQ ID NO: 11179 - RNA, 1629 nt, Artificial Sequence
  derived and/or modified sequence opt1 from VP1__Norovirus_and/or_Norovirus-like__X81879
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagaagaucaccauguucccccacgugaucaucgacguccggacgcucgagcccgugcugcugccccucccggacgugcgcaacuccuucuuccacuacaaccagaaggacgaccccaagaugcggaucgucgccaugcuguacacgccccugcgcagcaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccguccccaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccugaacaacgucaccaucaccaaccugaacgggagcccguucgaccccuccgaggacauccccgccccgcucggcgugcccgacuuccaggggcggguguucggcgucaucagccagcgcgacaagcagaacgcggccgggcacuccgagcccgccaaccggggccacgacgccguggugcccacguacaccgcccaguacaccccgaagcugggccagauccagaucgggaccuggcagacggacgaccugaccgucaaccagcccgugaaguucacccccgugggccucaacgacaccgagcacuucaaccagugggucgugccccgcuacgcgggggcccugaaccugaacacgaaccucgccccgagcguggcccccgucuuccccggcgagcggcugcuguucuuccgcagccaccucccccugaagggcggguacggcaacccggcgaucgacugccugcucccccaggagugggugcagcacuucuaccaggaggccgcccccuccaugagcgagguggcccugguccgguacaucaaccccgacaccgggcgcgcccuguucgaggcgaagcuccaccgggccggcuucaugaccguguccagcaacaccuccgccccgguggucgugcccgccaacggguacuuccgcuucgacagcugggugaaccaguucuacucccuggcccccaugggcacggggaacggccggcgccgcguccaguga

SEQ ID NO: 11180 - RNA, 1728 nt, Artificial Sequence
  derived and/or modified sequence opt1 from VP1__Norovirus_and/or_Norovirus-like__FJ875027
augaagauggccagcaacgacgccgcgcccccguccagcgacggcgccgccaaccuggugcccgagaucaacaacgaggucauggcccucgagcccguggccggggcgcagcuggccgcccccguggccggccaguucaacgcgaucgacccguggauccgccagaacuucguccaggcccccgagggggaguucaccgugagcccccggaacgcccccggcgagauccugcucaaccuggagcuggggccgcaccucaaccccuuccugcagcaccuggcccagauguacaacgccuacgcgggcggcauggaggugcaggucgugcucgccgggaacgccuucaccgccggcaagaucaucuucgccgcgaucccgccccacuucccgcccgagcgccuguccgccgcccaggccacgcaguucccccacgugaucgucgacgugcggcagcuggagcccaucgugcucccccugcccgacguccgccacaaccuguuccacuucaaccagcagaacgacgagcggaugcaccucguggccuuccuguacacgccccugcgcgcgaacuccgggaacggcgacgacguguucaccgucagcugccgggugcucacccgccccucccaggacuucgaguucauguuccuggugccgcccaccgucgagaagaagaccguggccuucagccugccccagcucgccgugggggagauguccaacagccgguggcccgcccgcaucaccggcauggucguggacccgcggcugccccaggugcugcacauccagaacggccgcugcacccucgacgggacgcugaugggcaccacccagcugaaccccaacgacaucugccggauccgcggguacuucuccagcucccggcccgagcuccugugcgagggcgaggagagcgaggucaacaccacgccgaccgacuccggcgccaccggggaccagacccccgaggugcgcacgggcacccgggcgacccagcgcugguucgccgucaccgagcugaacggccagguguacgaccccuucggggaccagccggcgccccucggggugcccgacuucaaggcccggauccugggcgcccugaugcgccuccccggcacgaacccgaccagcaacucccgguucgaggacgccugggucgagaccaacaaccagaccacguacgcccccgccaccggggugguggccaucaccaccaacgacaacagcuccggcaacuacgcgaacgaccagacgugcgaguucgucccccuggggaucgagaucaccgacagcgcccccuacaacgaguucgaccugccgagcuacggcggggccgccuccagcggcaaccgcaaccucgcccccaccguggcgcccaccuuccccggcgaggccauccugcuguucggguccaacaugccgguguacaaccgcagcuccggcacggacaacaaggacauccggugccuccugcccaacgaguacguccagcaccuguacgacacccaggcccccagccucuccgacguggcccuggugcgcuacgucaaccgggacaccgggcgcgugcuguucgaggccaagcuccaccgggacggcuucaugaccgugaacgcgagcuccacgaccguccugcccguggacggguacuuccgcuucgacagcugggugaaccaguucuacgcccuguccccggucggcaacgccagcggccggcgcuga

SEQ ID NO: 11181 - RNA, 1725 nt, Artificial Sequence
  derived and/or modified sequence opt1 from VP1__Norovirus_and/or_Norovirus-like__JF939046
augaagauggccagcaacgacgccgcgucccccagcuccgacggcgccgccaaccuggugccggagaucaacaacgaggucauggcccucgagcccguggccggggcgcagcuggccgcccccguggccggccaguucaacgcgaucgaccccuggauccgccagaacuucguccaggccccggagggggaguucaccgugagcccccggaacgcccccggcgagauccugcucaaccuggagcuggggccccaccucaacccguuccugcagcaccuggcccagauguacaacgccuacgcgggcggcauggaggugcaggucgugcucgccgggaacgccuucaccgccggcaagaucaucuucgccgcggugccgccccacuucccgcccgagcgccuguccgccgcccaggccacgcaguucccccacgucaucguggacgugcggcagcuggagcccaucauccucccccugccggacguccgccacaaccuguuccacuucaaccagcagaacgacgagcggaugcaccucguggccuuccuguacacgccccugcgcgcgaacagcggguccggcgacgacguguucaccgucagcugccgggugcucacccgccccucccaggacuucgaguucauguuccuggugcccccgaccgucgagaagaagaccguggccuucagccugccccagcucgccaucggggagauguccaacagccgguggcccgcccgcaucaccggccugguggucgacccccggcugccccaggugcuccacauccagaacggccgcugcacccuggacgggacgcugaugggcaccacccagcucaaccccaacgacaucugccggauccgcggguacuucuccagcucccggcccgagcugcugugcgagaacgaggagagcgccaccgaccccaugccgacggagaccgacaccgacaaccagccgcccgaggugcgcgcgcaggcccgggccacccagcgcugguucgccgucacggagcucaacggccagguguacgaccccuucggcgaccagcccgcgccccuggggguccccgacuucaaggcccggauccugggcgcccucaugcgccugccggggaccaaccccaccuccaacagccgguucgaggacgccuggguggagaccaacaaccagacgaccuacgcccccgcggccggcguggucgccaucaccaccaacgacaacuccagcagcaacuacgccaacgaccagacgugcgaguucgugccccuggggaucgagaucaccgacuccgccccguaccacgaguucgaccuccccagcuacggcggcgcggccuccagcgggaaccgcaaccuggcccccaccguggcccccaccuucccgggcgaggccauccuccucuucggguccaacaugcccgucuacaaccgcaacacgggcaccagcaacaaggacauccggugccugcugcccaacgaguacgugcagcaccucuacgacacccaggcgcccucccugagcgacguggcccugguccgcuacgugaaccgggacaccgggcgcgugcuguucgaggccaagcugcaccgggacggcuucaugacggucaacgccuccagcaccaccgugcugccgguggacggcuacuuccgcuucgacuccugggucaaccaguucuacgcgcucagccccguggggaacgccuccggccggcgcuga

SEQ ID NO: 11182 - RNA, 1722 nt, Artificial Sequence
  derived and/or modified sequence opt1 from VP1__Norovirus_and/or_Norovirus-like__JF930689
augaagauggccagcaacgacgccaccgcgcccucccaggacggcgccgccaaccuggugccggagagccagcacgagguccucgcccuggagcccguggccggggcggcccuggccgcccccguggcgggccaguucaacgccaucgaccccuggaucaagcagaacuucguccaggccccggccggggaguucaccgugagcccccgcaacgcccccggcgagauccucauggaccuggagcuggggcccgagcucaacccguuccuggcgcaccuggcccagauguacaacgccuacgccggcggcauggaggugcagaucauccucgccgggaacgcguucacggccggcaagaucaucgucugcgccgugccgcccaacuucccgcccgaccggcuguccgccucccaggccaccaacuucccccacgugaucauggacguccgcacccuggagcccgugauccucccccugcccgacgugcgggcgggguucuuccacuacaaccagcugcgcgagccccggaugcgccucauggcccugcuguacacgccccuccgggccaacggcaccggggacgacgccuucaccgucagcugccgcgugcugacccggcccaugcaggacuucgaguucauguuccuggugccgcccaccgucgagucccgcgugacgcccuucagcgugcccaccuacccggucguggagaugaccaacucccgguggcccgcccgcaucagcggcaugcacgugaacgcgaaccagacccucgccguccaguuccagaacggccggugcacgcuggacgggcagcugaugggcaccacccagcucugcgccgccgacgugugccgcaugcgggggcgcuacaccuccacgcgggcggaccuggccggcguggaccacaccgaccagggccccagccuggggaccggccccuccgacgacagcgucuccgugccggaggcccgcgcccagacccggacgggggucagcgcccaccuccagcuggaggagcugaacggccagcccuacgagguguacggggagcagcccgcgccgcucggcacccccgacuuccgcugccggcugaugggcgagcuggugcgccuccccuccaccagccccgccgcccagucccgcuuccgggacgccuucuucgacaccuacggggcccuguucgcgccggccgucggcagcacgaccuucaccgugaacaacagcuccaccagcgacuucgccaacgggcagcccuucgaguuccugcccaucggcguggagaucgggaacuccgcccaguacgacgaguucgcccuccccagcuacaacggcgcgaucggcgagaaccgccaccuggccccggucgccgcccccggguuccccggcgagaacaucguguucuucuccagcaaccugcccgugugggacuccacgagcgcgcagaacaaccggcgcaucuccugccuccugccgaacgaguucguccagcacuucuacgaccugcaggcccccagccaguccgacguggcccuccugcgguacgugcaccccgagagcgggcgcguccuguucgagugcaagcucuaccgggacggcuuccugaccgugaacggggccucccuggccgaguuccccgugaacggcuacuuccgcuucgacagcugggucaaccaguucuucacccucuccccggugggcaccgggagcggccggcgcuga

SEQ ID NO: 11183 - RNA, 1719 nt, Artificial Sequence
  derived and/or modified sequence opt1 from VP1__Norovirus_and/or_Norovirus-like__GQ443611
augaagauggccagcaacgacgccaccgcgcccucccaggacggcgccgccaaccuggugccggagagccagcacgagguccucgcccuggagcccguggccggggcggcccuggccgcccccguggcgggccaguucaacgccaucgaccccuggaucaagcagaacuucguccaggccccggccggggaguucaccgugagcccccgcaacgcccccggcgagauccucauggaccuggagcuggggcccgagcucuccccguuccuggcgcaccuggcccagauguacaacgccuacgccggcggcauggaggugcagaucauccucgccgggaacgcguucacggccggcaagaucaucgucugcgccgugccgcccaacuucccgcccgaccggcuguccgccagccaggccaccaacuucccccacgugaucauggacguccgcacccuggagcccgugauccucccccugcccgacgugcgggcgggguucuuccacuacaaccagcugcgcgagccccggaugcgccucauggcccugcuguacacgccccuccgggccaacggcaccggggacgacgccuucaccgucuccugccgcgugcugacccggcccaugcaggacuucgaguucauguuccuggugccgcccaccgucgagagccgcgugacgcccuucuccgugcccaccuacccggucguggagaugaccaacagccgguggcccgcccgcaucuccggcaugcacgugaacgcgaaccagacccucgccguccaguuccagaacggccggugcacgcuggacgggcagcugaugggcaccacccagcucugcgccgccgacgugugccgcaugcgggggcgcuacaccagcacgcgggcggaccuggccggcguggaccacaccgaccagggccccucccugggggccggccccagcaacgacccggucuccgugcccgaggcccgcagccagacccggaccuccgucagcgcccaccuccagcuggaggagcugaacgggcagcccuacgagguguacggcgagcagccggcgccccucgggacgcccgacuucugcugccgccugaugggcgagcuggugcggcuccccuccaccagcccggccgcccagagccgcuuccgcgacgccuucuucgacaccuacggcgcccuguucgcgcccgccgucggguccaccacguucaccgugaacaacagcuccaccagcgacuucgccaacggccagcccuucgaguuccugcccaucgggguggagaucggcaacuccgcccaguacgacgaguucgcccucccgagcuacaacggggcgaucggcgagaaccggcaccuggcccccgucgccgcccccggcuuccccggggagaacaucguguucuucuccagcaaccugccggugugggacuccaccagcgcgcagaacaaccgccggaucuccugccuccugcccaacgaguucguccagcacuucuacgaccugcaggcccccagccaguccgacguggcccuccugcgcuacgugcaccccgagagcggccggguccuguucgagugcaagcucuaccgcgacggguuccugacggugaacggcgccucccuggccgaguucccggugaacggguacuuccgguucgacagcugggucaaccaguucuucacccucucccccgugggcaccggcagcgggcgcuga

SEQ ID NO: 11184 - RNA, 1719 nt, Artificial Sequence
  derived and/or modified sequence opt1 from VP1__Norovirus_and/or_Norovirus-like__EU224456
augaagauggccagcaacgacgccgcgcccuccagcgacggcgccgggaaccuggugccggagucccaccaggagguccucccccuggcccccguggccggcgccgcgaucgccgcccccguggucgggcagcagaacaucaucgacccguggaucaaggagaacuucgugcaggcgccccagggcgaguucaccgugagccccaagaacucccccggggagguccuggugaaccucgagcugagcccgaagcugaaccccuaccucgaccaccuguccaagauguacaacgccuacgccggcggcauggagaucgagaucauccuggccgggaacgccuucaccgccggcaaggugcucaucgcggccgucccgcccaacuuccccguggagaacaucagcgugucccaggccagccaguucccccacgucaucguggacgugcgcacgcuggagcccauccggcugccccucccggacguccgcaccaacuucuuccacuacaccacccgggacgagcccaagaugcgcaucguggccuggcuguacacgccccugcggaccaacggguccggcgacgacagcuucaccguguccgggcgcauccucacccggcccagcgccgacuucgaguucuccuuccuggucccgcccacgguggagaccaagaccgugagcuucuccguccccggccugaccguggaggagaugagcaacucccgcuggcccgcgcagaucaacggccucgugguccgggggaacgaggcccaggugguccacuuccagaacggccgcugcacgaccgaggggaugcugcugggcaccaccacgcucaacgugaacagcaucugcggccugcgggggaccagcaucucccacgccagcgugcgcgaggccccggcccuguccgaggagaugccgccccucgaggacgaggucgcgcacggcgccgccgccaccuacgccguggggcgggcggccgacaccacgcuguggauccgcguggaggagcccaacggccagcccuacgacaucuucggggagcagcccgcgccccugggcaccccggacuucaccgccgucaucaucggcaccgccauccggccccgcacggccagcggggccuaccuccacgacgccuacguggacacccggcccggcgacgccgacuucacccccuccaccgggaacacgaagaucgugcugcgcggcgggggcagcggccacgucggggagggccacuacuggcaguucaagccgaucgcgguggagggcgggcccaaccggcccguguaccaggaguacaaccugcccgaguacgccgggccgaccgccuccaaccacaaccucgccccgcccgucgcccccaagaugcccggcgagcugcugcuccuguucgagagcgacaugcccgugugggacaacggcuccgggagcgcgcccacccagaagauccacugccugcuccccaacgacuucgugacccacuucuucgaccugcaggccccggcccuggccgaggccgcgcuccugcgcuacguccaccccgacuccggccggacgcuguucgagugcaagcucuaccgcgagggguacauggugguggucgcccccagcggccgccuggacuucccccuggacggcuacuuccgguucgacuccugggugaacgccuucuacgugcucagcccggucgggaacggccaggggcgccgguga

SEQ ID NO: 11185 - RNA, 1719 nt, Artificial Sequence
  derived and/or modified sequence opt1 from VP1__Norovirus_and/or_Norovirus-like__EF450827
augaagauggccagcuccgacgccacccccagcuccgacggcgcggggaaccuggugccggagagccagcaggagguccucccccuggcccccguggccggcgccgcccuggcggcccccguggucgggcagcagaacaucaucgacccguggaucaaggagaacuucgugcaggcgccccagggcgaguucaccgugucccccaagaacagccccggggagguccucgugaaccuggagcuguccccgcgccucaaccccuaccugcaccaccugagcaagauguacaacgccuacgccggcggcauggagguggagaucauccucgccgggaacgccuucacggccggcaagguccugaucgccgcggugccgcccaacuuccccaucgagaacguguccgccagccaggccucccaguucccccacgucaucguggacgugcggacccuggagcccauccgccucccccugccggacguccggaccaacuucuuccacuacaccacgcaggaggagccccgcaugcggaucguggccuggcuguacacgccccuccgcaccaacgggagcggcgacgacuccuucaccgugagcgggcggauccugacccgccccuccccggacuucgaguucagcuuccuggucccgcccaccguggagaccaagaccguguccuucagcguccccggccucguggugcaggacauguccaacagccgguggcccgcccagaucagcggccuggucgugcgcgggaacgaggcgcaggucgugcacuuccagaacggccggugcacgaccgaggggaugcugcucggcaccaccacgcugaacaucaacuccaucugcggccugcgcgggcucagcgugucccaggccagcguccggggcgcccccgcccugaccgaggagaugccgccccuggaggacgagguggccgacggggcggccgccaccuacacccucacgcgcgccgccgacaccgcgcuguggcugcggguggaggagcccgacggccgccccuacgacaucuucggggaccagcccgccccgcucggcacccccgacuucaccgccgucaucgugggcacggccauccggccccgcaccaccuccggggcguaccugcacgacgccuacguggacaccacgcccggcgacgccgacuucaccccgagcaccgggaacaccaagaucguccugcggggcgggggcuccggccacguggggcagggccacuacuggcaguucaagcccaucgccguggagggcggcgggagccgcccccaguaccaggaguacaaccuccccgacuacgccgggccgacggcguccaaccacgaccuggccccgcccgucgcgccccggaugcccggcgagcugcuccugcuguucgagagcgacaugcccgugugggacaacggggccggcgccgcccccgcccagaagauccacugccuccugcccaacgaguucaucacccaccuguucgaccuccaggccccggcccuggccgaggcggcccugcuccgcuacgugcaccccgacuccgggcgcacccuguucgagugcaagcuguaccgggagggcuacauggucguggccgcccccgugggccgccucaacuucccccuggacggguacuuccgguucgacagcugggucuccgcguucuacgugcugagcccggugggcuccgggcagggccgccgguga

SEQ ID NO: 11186 - RNA, 1719 nt, Artificial Sequence
  derived and/or modified sequence opt1 from VP1__Norovirus_and/or_Norovirus-like__JF781268
augaagauggccagcuccgacgccacccccagcuccgacggcgcggggaaccuggugccggagagccagcaggagguccucccccuggcccccguggccggcgccgcccuggcggcccccguggucgggcagcagaacaucaucgacccguggaucaaggagaacuucgugcaggcgccccagggcgaguucaccgugucccccaagaacagccccggggagguccucgugaaccuggagcuguccccgcgccucaaccccuaccuggaccaccugagcaagauguacaacgccuacgcgggcggcauggagguggagaucauccucgccgggaacgccuucacggccggcaagguccugaucgccgcggugccgcccaacuuccccaucgagaacaucuccgccagccaggccucccaguucccccacgugaucgucgacgugcggacccuggagcccauccgccucccccugccggacgugcggaccaacuucuuccacuacaccacgcaggaggagccccgcaugcggaucgucgccuggcuguacacgccccuccgcaccaacgggagcggcgacgacuccuucaccgugagcgggcggauccugacccgccccuccccggacuucgaguucagcuuccuggugccgcccaccgucgagaccaagaccguguccuucagcgugcccggccucgucguggaggacauguccaacagccgguggcccgcccagaucaacggccuggugguccgcgggaacgaggcccaggugguccacuuccagaacggccggugcacgaccgaggggacccugcucggcaccacgacccugagcaucaacuccaucugcggccugcgcgggcucagcgugucccaggccagcgugcggggcgcccccgcccugaccgaggagaugccgccccuggaggacgaggucgccgacggggcggccgccaccuacacgcucgcccgcgccgcggacaccacccuguggcugcggguggaggagcccgacggccgccccuacgacaucuucggggaccagcccgccccgcucggcacccccgacuucacggccgugaucgucggcaccgccauccggccccgcaccgcguccggggccuaccugcacgacgccuacguggacaccacgcccggcgacgccgacuucaccccgagcaccgggaacaccaagaucgugcugcggggcgggggcuccggccacgucgggcagggccacuacuggcaguuccgccccaucgccguggagggcggcgggagccggccccaguaccaggaguacaaccuccccgacuacgcggggccgacggccuccaaccacgaccuggccccgcccguggcgccccgcaugcccggcgagcugcuccugcuguucgagagcgacaugcccgucugggacaacggggccggcgccgcccccgcccagaagauccacugccuccugcccaacgaguucaucacccaccuguucgaccuccaggccccggcccuggcggaggccgcccugcuccgcuacgugcaccccgacuccgggcggacccuguucgagugcaagcuguaccgcgagggcuacaugguggucgccgcgcccgccggccggcucaacuucccccuggacggguacuuccgcuucgacagcuggguguccgccuucuacauccugagcccggugggcuccgggcagggccggcgcuga

SEQ ID NO: 11187 - RNA, 1698 nt, Artificial Sequence
  derived and/or modified sequence opt1 from VP1__Norovirus_and/or_Norovirus-like__KT245136
augaagauggccagcaacggcgccgcggcccccucccaggacggggccgccaaccuggugccggagagccagcaggagguccucgcccuggagcccguggcgggcgccgcccuggccgcgcccguggccgggcaguucaacgccaucgaccccuggaucaagcagaacuucguccaggccccggccggcgaguucaccgugagcccccgcaacgcgcccggggaggugcucauggaccuggagcugggccccgagaugaacccguuccucgcccaccuggcccagauguacaacgccuacgccggcgggauggagguccagaucauccuggcgggcaacgccuucaccgccgggaagaucaucgugugcgccgugccgcccaacuucccgcccgaccggcucuccgccucccaggcgacgaacuucccccacgucaucauggacgugcgcacccuggagcccgugguccugccccuccccgacgugcgggccggcuucuuccacuacaaccagcugcgcgagccccggaugcgccugaugacccuccuguacacgccccugcgggccaacgggaccggcgacgacgccuucaccgugagcugccgcguccucacccggcccaugcuggacuucgaguucauguuccuggugccgcccaccguggagucccgcgucacgcccuucagcgugcccaccuacccgguggucgagaugaccaacucccgguggcccgcccgcaucagcggcaugcacgugaacgcgaaccagacccucgccgugcaguuccagaacgggcggugcacgcuggacggccagcugauggggaccacccagcucugcgccgccgacgucugccgcaugcggggccgcuacaccuccacgcgggcggaccccgccggccuggggugggaccuggacgccaccacccucguggacggccccgaggcccgcguccaggcccggaucagcguguccgcgcaccuccagcuggaggagcugagcgggcagccguacgagguguacggcgagcagcccgcgccccuggggaccccggacuuccagugccgccugaugggcgagcucguccggcugcccuccgccaaccccguggcccagagccgcuuccgcgacgccuucuucgacacguacggcgcccuguucgcccccgccgugggguccgucaccgugaccgugaacaacagcuccagcagcgacuucgccaacgaccagccguucgaguuccuccccaucggcgucgagaucgggaacuccgcccgguacgacgaguucgcgcugcccagcuacaacggcgccaucggggagaaccgccaccuggcccccaucgccgcgccgggcuuccccggcgagaaccucaucuucuucuccagcaaccugcccgugugggacuccaccagcgcccaguccaaccggcgcaucagcugccugcuccccaacgaguucauccagcacuucuacgaccugcaggccccgucccagagcgacguggcccugcuccgguacguccaccccgagacggaccgcuuccuguucgagugcaagcuguaccgggacgccuuccucaccgugaacggggcguccuacgccgaguuccccgugaacggcuacagccgcuucgacuccugggucaagcaguucuucacccugagccccguggggaccggcuccgggcggcgcuga

SEQ ID NO: 11188 - RNA, 1659 nt, Artificial Sequence
  derived and/or modified sequence opt1 from VP1__Norovirus_and/or_Norovirus-like__AJ844470
augaagauggccagcaaggacgccucccccagcaccgacggcgcggccaaccuggugccggagucccagcaggagguccucgcccugcagcccguggccggggcccagaucgcggcccccguggccggccaguucaacgucaucgaccccuggaucuaccagaacuucgugcaggccccggagggggaguucaccgugagcccccgcaacuccacgggcgagauccugaugaaccucgagcuggggccccagcugaaccccuaccucgcgcaccuggcccggauguacaacgccuacgccggcggcuucgagguccaggugcugcucgccgggaacgcguucaccgccggcaagaucaucgugugcgccgucccgcccaacuucccccugcagaacaucagcgccgcccaggcgacccagcugccccacgugguggucgacgugcgccagcucgagccggugguccugccccugcccgacgugcgggccggguucuaccacuacaaccagguggaggagucccgcaugcggcucgucgccauccuguacacgccccugcgcaccaacagcgccggcgacgacgccuucaccguguccugccggauccucacccgcccggcgcccgacuucagcuucuucuuccugaucccgcccaccaucgaguccaagacgacccccuucacccugccccggcuccccaucagcgagaugaccaacucccgcuucccccuggugaucaaggggauggucguggacccgaaccugccccuccaggccaacuuccagaacggccggaucacgcuggacggcgagcugcaggggaccacccuccccaccagcacguccaucggccgcaucagcgggaccuacauguccagcacccccucccggaucauccagcacgaggacagcggcgacagcacccagccgcgcguguucaaccccgucuggauggaccugacggagaacaacuggaccgaguuccagcccuucaacgaccagccggcgccccugggcugccccgacuucaaggccaagauccucgggacccugauccggcagcccaacaacggcuccuacuacuucgacgccuaccuggacacccgccagcacgggacguucgccccguacaccggccacgccgccgugcacagcgaccagcaggccgggcaccucgcgcagggcuacaagauccaguucucccccaccggcaucgagagcgaccagaacaccgaccugaaccagcugcccgacuacgggggcgccaugacggucuccaaggggcucgcccccgccgccgcgccggacuuccccggcgagaugauccuguacuucgugagcgacaugcccgugcggaaccccaacggggagcgccgggacaccgagauccugugccuccugccgcaggagauggucacccacuucuacgagcagcaggcccccucccagggcgacguggcccuggugcgcuacaucaacgccgagaccggccgggucauguucgaggggaagcuccaccgcaacggcuucuucacggugagcgccaccgcgcgcacccugaucgugcccgacggguacuuccgguucgacuccugggucaaccgcuucuacacccugagccccaugggcacggggaacggccggcgccgggcccgcuga

SEQ ID NO: 11189 - RNA, 1659 nt, Artificial Sequence
  derived and/or modified sequence opt1 from VP1__Norovirus_and/or_Norovirus-like__KJ196291
augaagauggccagcaaggacgccucccccagcaccgacggcaccgcgaaccuggugccggagucccagcaggagguccucgcccugcagcccguggccggggcccagaucgccgcgcccguggccggccaguucaacgucaucgaccccuggaucuaccagaacuucgugcaggccccggagggggaguucacggugagcccccgcaacuccaccggcgagauccugaugaaccucgagcuggggccccagcugaaccccuaccucgcccaccuggcgcggauguacaacgccuacgccggcggcuucgagguccaggugcugcucgccgggaacgccuucaccgcgggcaagaucaucgugugcgccgucccgcccaacuucccccugcagaacaucagcgccgcccaggccacccagcugccccacgugguggucgacgugcgccagcucgagccggugguccugccccugcccgacgugcgggcgggguucuaccacuacaaccagguggaggagucccgcaugcggcucgucgccauccuguacacgccccugcgcaccaacagcgccggcgacgacgccuucaccguguccugccggauccucacccgcccggcccccgacuucagcuucuucuuccugaucccgcccacgaucgaguccaagaccacccccuucacccugccccggcuccccaucagcgagaugacgaacucccgcuucccccuggugaucaaggggauggucguggacccgaaccugccccuccaggcgaacuuccagaacggccggaucacccuggacggcgagcugcaggggaccacccuccccacgagcaccuccaucggccgcaucagcgggacccacauguccagcacccccucccggaucauccagcacgaggacagcggcgacagcacgcagccgcgcguguucaaccccgucuggauggaccugaccgagaacaacuggaccgaguuccagcccuucaacgaccagccggcgccccugggcugccccgacuucaaggccaagauccucgggacccugauccggcagcccaacaacggcuccuacuacuucgacgccuaccuggacacgcgccagcacgggaccuucgccccguacaccggccacgccgccgugcacagcgaccagcaggccgggcaccucgcccagggcuacaagauccaguucucccccaccggcaucgagagcgaccagaacacggaccugaaccagcugcccgacuacgggggcgcgaugaccgucuccaaggggcucgcccccgccgccgccccggacuuccccggcgagaugauccuguacuucgugagcgacaugcccgugcggaaccccaacggggagcgccgggacaccgagauccugugccuccugccgcaggagauggucacccacuucuacgagcagcaggcgcccucccagggcgacguggcccuggugcgcuacaucaacgccgagacgggccgggucauguucgaggggaagcuccaccgcaacggcuucuucaccgugagcgccaccgcccgcacccugaucgugcccgacggguacuuccgguucgacuccugggucaaccgcuucuacacgcugagccccaugggcaccgggaacggccggcgccgggcgcgcuga

SEQ ID NO: 11190 - RNA, 1653 nt, Artificial Sequence
  derived and/or modified sequence opt1 from VP1__Norovirus_and/or_Norovirus-like__KU870455
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaacgcccgcgcggccgaccucaccgacuccccgcagcgggcccgcgaccacccccugcacgugcaggucaagaaccuggacgggacccaguacgaccccaccgacgacaucccggccgugcucggcgccaucgacuucaagggcacgguguucggggucgcgagccagcgggacguguccggcacccaggagcaggggcacuacgccacccgcgcccacgaggcccacaucgacaccacggaccccaaguacgcgcccaagcugggcaccauccugaucaagagcgaguccaccgacuucaccacgaaccagcccauccgguucaccccgguggggaugggcgacaacaacuggcgccagugggagcuccccgacuacagcggcagccugacccugaacaugaaccucgcccccgccgucucccccagcuucccgggggagcggauccuguucuuccgcuccaucgugcccagcgccggcggguacggcuccggguacaucgacugccugaucccccaggagugggugcagcacuucuaccaggaggccgcgcccagccaguccgccgucgcccucgugcgcuacgugaacccggacaccggccggaacaucuucgaggccaagcugcaccgcgagggcuuccugacggucgccaacagcgggaacaaccccaucguggugccgcccaacggcuacuuccgguucgaggcgugggucaaccaguucuacacccucgcccccaugggguccggccaggggcgccggcgcgcccaguga

SEQ ID NO: 11191 - RNA, 1653 nt, Artificial Sequence
  derived and/or modified sequence opt1 from VP1__Norovirus_and/or_Norovirus-like__AF414408
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugaagcagcucgagcccguccugcugccccuccccgacauccggaaccgcuucuuccacuacaaccaggaggacaccccgcggaugcgccugguggccaugcuguacacgccccuccgggccaacagcggcgaggacguguucaccgucuccugccgcgugcugacccggcccgcgcccgacuucgaguucaccuuccuggugccgcccaccgucgagagcaagaccaagcccuucacgcuccccauccugacccugggggagcucuccaacagccgcuucccggccgccaucgacaugcuguacaccgaccccaacgaguccaucguggugcagccccagaacggccggugcacccuggacggcacgcuccaggggaccacccagcugguccccacccagaucugcgccuuccgcggcacgcugaucagccagaccgcccgggcggccgacuccaccgggagcccgcagcgcgcccggaaccacccccuccacgugcaggucaagaaccuggacggcacccaguacgaccccacggacgacaucccggccgugcugggcgccaucgacuucaaggggaccguguucggcgucgcgucccagcgcgacgugagcgggcagcaggagcagggccacuacgccacccgggcccacgaggcccacaucgacaccacggaccccaaguacgcgcccaagcucgggaccauccugaucaaguccgacagcgacgacuucaacaccaaccagcccauccgcuucaccccggugggcaugggcgacaacaacuggcggcagugggagcugcccgacuacagcgggcaccucacgcugaacaugaaccuggcccccgccgucucccccagcuucccgggcgagcgcauccucuucuuccgguccaucgugcccagcgccgggggcuacggguccggcuacaucgacugccugaucccccaggagugggugcagcacuucuaccaggaggccgcgcccagccaguccgccgucgcccuggugcgcuacgugaacccggacaccggccgcaacaucuucgaggccaagcuccaccgggagggguuccugaccgucgccaacagcggcaacaaccccaucguggugccgcccaacggguacuuccgcuucgaggcgugggucaaccaguucuacacccuggcccccaugggcuccgggcagggccggcgccgggcccaguga

SEQ ID NO: 11192 - RNA, 1653 nt, Artificial Sequence
  derived and/or modified sequence opt1 from VP1__Norovirus_and/or_Norovirus-like__AB084071
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcggccgacuccaccgacagcccgcagcgggcccgcgaccacccccuccacgugcaggucaagaaccuggacgggacccaguacgaccccacggacgacaucccggccgugcugggcgccaucgacuucaagggcaccguguucggggucgcgucccagcgggacgugagcggcccccaggagcaggggcacuacgccacccgcgcccacgagacccacaucgacacgaccgaccccaaguacgcccccaagcucggcaccauccugaucaaguccgagagcaacgacuucaucaccaaccagccgauccgguucacgcccguggggaugggcgacaacaacuggcgccagugggagcugcccgacuacagcggccggcucacccugaacaugaaccuggcgcccgccgucuccccgagcuuccccggggagcgcauccucuucuuccgcuccaucgugcccagcgccggcggguacggcuccggguacaucgacugccugaucccccaggagugggugcagcacuucuaccaggaggccgccccgagccaguccgcggucgcccuggugcgguacgugaaccccgacaccggccgcaacaucuucgaggccaagcuccaccgggagggcuuccugaccgucgccaacagcgggaacaaccccaucguggugcccccgaacggcuacuuccgcuucgaggccugggucaaccaguucuacacgcuggcgcccaugggguccggccaggggcggcgccgggcccaguga

SEQ ID NO: 11193 - RNA, 1653 nt, Artificial Sequence
  derived and/or modified sequence opt1 from VP1__Norovirus_and/or_Norovirus-like__AF414407
augaagauggccagcaacgacgccgcgcccuccaacgacggcgccgccaaccuggugccggaggccaacaacgaggucauggcccucgagcccguggugggggcgagcaucgccgcccccgccgucggccagcagaacaucaucgaccccuggauccgcgagaacuucgugcaggcgccgcagggggaguucaccgugagcccccggaacucccccggcgagaugcugcugaaccucgagcuggggcccgagcugaacccguaccucucccaccugagccgcauguacaacggcuacgccggcgggaugcagguccagguggugcuggccggcaacgccuucaccgccgggaagaucaucuucgcggccgucccgccccacuuccccguggagaacaucuccgccgcccagaucacgaugugcccccacgugaucgucgacgugcggcagcucgagcccgugcugcugccccuccccgacauccgcaaccgguucuuccacuacaaccaggagaacaccccgcgcaugcggcuggucgccaugcuguacacgccccuccgcgcgaacagcggcgaggacguguucaccguguccugccggguccugacccgccccgcccccgacuucgaguucaccuuccuggugccgcccaccguggagagcaagaccaagcccuucacgcuccccacccugacccugggggagcucuccaacccgcgguuccccgccgccaucgacaugcuguacaccgaccccaacgagagcaucgucgugcagccccagaacggccgcugcacgcuggacggcacccuccaggggaccacccagcuggugccgacgcagaucugcgccuuccggggcacccugaucucccagaccgcgcgcgccgccgacagcaccgacagcccccagcgggcccgcaaccacccccuccacguccaggugaagaaccuggacgggacgcaguacgacccgaccgacgacauccccgccguccugggcgcgaucgacuucaagggcaccguguucgggguggccucccagcgggacgucuccggccagcaggagcaggggcacuacgccacccgcgcccacgaggcgcacaucgacacgaccgaccccaaguacgcccccaagcucggcaccauccugaucaagagcgacuccgacgacuucaacaccaaccagccgauccgguucacgcccguggggaugggcgacaacaacuggcgccagugggagcugcccgacuacagcggccggcucacccugaacaugaaccuggcccccgccgugagcccguccuuccccggggagcgcauccucuucuuccgcagcaucguccccuccgccggcggguacggcagcggguacaucgacugccugaucccccaggagugggugcagcacuucuaccaggaggcggccccgucccagagcgccguggcccugguccgguacgugaaccccgacaccggccgcaacaucuucgaggccaagcuccaccgggagggcuuccugaccguggcgaacuccgggaacaaccccaucgucgugcccccgaacggcuacuuccgcuucgaggccugggugaaccaguucuacacgcuggcccccauggggagcggccaggggcggcgccgggcccaguga

SEQ ID NO: 11194 - RNA, 1653 nt, Artificial Sequence
  derived and/or modified sequence opt1 from VP1__Norovirus_and/or_Norovirus-like__AB039777
augaagauggccagcaacgacgccgcgcccuccaacgacggcgccgccaaccuggugcccgaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccccauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcgccagcucgagcccgucccccugccgcugcccgacauccggaaccgcuucuuccacuacaaccaggagaacacgccccggaugcgccucguggccaugcuguacacgccccugcgggccaacagcggcgaggacguguucaccgucuccugccgcgugcucacccggccggcgcccgacuucgaguucaccuuccuggugccgcccaccgucgagagcaagaccaagcccuucacccugcccauccucacccugggggagcuguccaacagccgcuuccccgccgccaucgacaugcucuacaccgaccccaacgaguccaucguggugcagccgcagaacggccggugcacccuggacggcacgcugcaggggaccacccagcucguccccacccagaucugcgccuuccgcggcacgcugaucagccagaccgcccgggcggccgacuccaccgacagcccccagcgcgcccgggaccacccgcugcacgugcaggucaagaaccucgggggcacccaguacgaccccacggacgacauccccgccgugcugggcgccaucgacuucaaggggaccguguucggcgucgcgucccagcgcgacgugagcgggccccaggagcagggccacuacgccacccgggcccacgaggcccacaucgacaccacggacccgaaguacgcgcccaagcuggggaccauccucaucaaguccgagagcaacgacuucaccaccaaccagcccauccgcuucacgcccgugggcaugggcgacaacaacuggcggcagugggagcugccggacuacagcgggcgccugacccucaacaugaaccuggcccccgccgucucccccagcuuccccggcgagcggauccuguucuuccgcuccaucgugccgagcgccgggggcuacggguccggcuacaucgacugccucaucccccaggagugggugcagcacuucuaccaggaggccgcgcccagccaguccgccgucgcccuggugcgcuacgugaaccccgacaccggccggaacaucuucgaggccaagcugcaccgcgagggguuccucaccgucgccaacagcggcaacaacccgaucguggugccgcccaacggguacuuccgguucgaggcgugggucaaccaguucuacacgcuggcccccaugggcuccgggcagggccgccggcgcgcccaguga

SEQ ID NO: 11195 - RNA, 1653 nt, Artificial Sequence
  derived and/or modified sequence opt1 from VP1__Norovirus_and/or_Norovirus-like__AB078337
augaagauggccagcaacgacgccgcgcccuccaacgacggcgccgccaaccuggugccggaggccaacgacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcggccgacuccaccgacagcccgcagcgggcccgcaaccacccccuccacgugcaggucaagaaccuggacgggacccaguacgaccccacggacgacaucccggccgugcugggcgccaucgacuucaagggcaccguguucggggucgcgucccagcgggacgugagcggccagcaggagcaggggcacuacgccacccgcgcccacgaggcccacaucgacaccacggaccccaaguacgcgcccaagcucggcaccauccugaucaaguccgggagcgacgacuucaacaccaaccagcccauccgguucaccccggugggcaugggcgacaacaacuggcgccagugggagcugcccgacuacagcgggcggcucacgcugaacaugaaccuggcccccgccgucucccccagcuucccgggcgagcgcauccucuucuuccgcuccaucgugcccagcgccgggggcuacggguccggcuacaucgacugccugaucccccaggagugggugcagcacuucuaccaggaggccgcgcccagccaguccgccgucgcccuggugcgguacgugaacccggacaccggccgcaacaucuucgaggccaagcuccaccgggagggguuccugaccgucgccaacugcggcaacaaccccaucguggugccgcccaacggguacuuccgcuucgaggcguggggcaaccaguucuacacccuggcccccauggggagcggccagggccggcgccgggcccaguga

SEQ ID NO: 11196 - RNA, 1653 nt, Artificial Sequence
  derived and/or modified sequence opt1 from VP1__Norovirus_and/or_Norovirus-like__AB039776
augaagauggccagcaacgacgccgcgcccuccaacgacggcgccgccaaccuggugcccgaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccccauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcgccagcucgagcccgucccccugccgcugcccgacauccggaaccgcuucuuccacuacaaccaggagaacacgccccggaugcgccucguggccaugcuguacacgccccugcgggccaacagcggcgaggacguguucaccgucuccugccgcgugcucacccggccggcgcccgacuucgaguucaccuuccuggugccgcccaccgucgagagcaagaccaagcccuucacccugcccauccucacccugggggagcuguccaacagccgcuuccccgccgccaucgacaugcucuacaccgaccccaacgaguccaucguggugcagccgcagaacggccggugcacccuggacggcacgcugcaggggaccacccagcucguccccacccagaucugcgccuuccgcggcacgcugaucagccagaccgcccgggcggccgacuccaccgacagcccccagcgcgcccgggaccacccgcugcacgugcaggucaagaaccucgacgggacccaguacgaccccacggacgacauccccgccgugcugggcgccaucgacuucaagggcaccguguucggggucgcgucccagcgcgacgugagcggcccccaggagcaggggcacuacgccacccgggcccacgaggcccacaucgacaccacggacccgaaguacgcgcccaagcugggcaccauccucaucaaguccgagagcaacgacuucaccaccaaccagcccauccgcuucacgcccguggggaugggcgacaacaacuggcggcagugggagcugccggacuacagcggccgccuggcccucaacaugaaccuggcccccgccgucucccccagcuuccccggggagcggauccuguucuuccgcuccaucgugccgagcgccggcggguacggcuccggguacaucgacuaccucaucccccaggagugggugcagcacuucuaccaggaggcggcccccagccaguccgccgucgcccuggugcgcuacgugaaccccgacaccggccggaacaucuucgaggccaagcugcaccgcgagggcuuccucaccgucgcgaacagcgggaacaacccgaucguggugccgcccaacggcuacuuccgguucgaggccugggucaaccaguucuacacccuggcccccaugggguccggccaggggcgccggcgcgcccaguga

SEQ ID NO: 11197 - RNA, 1653 nt, Artificial Sequence
  derived and/or modified sequence opt1 from VP1__Norovirus_and/or_Norovirus-like__KT030674
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggagggcgucagcgccucccaggccacccaguucccccacgugaucaucgacgugcggacccuggaccccguccgccucccccugccggacgugcggagcacguucuuccacuacaccaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagacgaagaccacccccuucuccgugcccggguucagcguccaggagauguccaacagccgcuggccggccgcgaucuccgccaugguggugcggggcaacgagccccaggucgugcaguuccagaacgggcgcgcccaccuggacggcaugcugcucggcaccacgcccgucagccccaacuacaucgccagcuaccgggggaucuccaccggcaacagccgcuccgccagcuccgaggcggacgagcgggccguggggagcuucgacguguggguccgccugcaggagccggacggccagcccuacgacaucuucgggaagcagcccgccccgaucggcacccccgacuucaaggccgugaucgugggcuucgccgcgcggccccugaccuccgggagcuacgccaacgaggccuacgucaacacgaccgccuccgacuacgcgcccgccaccggcaacaugcgcuucaccgugcggaacgggggcacggggcacaucagcgccaacaaguacugggaguucaaguccuucggcguggagggcgagcgccacaccgacauccaguaccaggaguacgagcucccggacuacagcgggcaggucgccuccaaccacaaccuggccccgcccguggcgccccggaugcccggcgagagccugcuccuguuccaguccaacaugcccgugugggacgacgggcgcggcgagagcacccccaagaagauccacugccugcucccccaggaguucaucgggcacuucuucgacaagcaggccccgucccugggcgacgccgcccugcuccgguacgucaaccaggagaccaaccgcgugcuguucgagugcaagcuguaccgcgacggcuacaucacgguggccgcgagcuccgggcuccuggacuucccccuggacggcuucuuccgguucgacagcugggucagcuccuucuacauccucagccccgugggguccggccagggccgccgguga

SEQ ID NO: 11198 - RNA, 1653 nt, Artificial Sequence
  derived and/or modified sequence opt1 from VP1__Norovirus_and/or_Norovirus-like__DQ093067
augaagauggccagcaacgacgccgcgcccuccaccgacggcgccgggaaccuggugccggagagccagcaggagguccucccccuggcccccguggccggcgccgcgcuggccgcccccguggucgggcagaccaacaucaucgacccguggaucaaggagaacuucgugcaggcgccccagggcgaguucacggugucccccaagaacagccccggggagauccucgucaaccuggagcugggcccgaagcucaaccccuaccuggaccaccugucccgcauguacaacagcuacgccggcgggaucgacgugauggugguccucgccggcaacgccuucaccgccgggaaggugcugaucgccgcgaucccgcccaacuuccccguggagggcgucuccgccagccaggccacccaguucccccacguggugaucgacguccggacccuggaccccgugcgccucccccugccggacgugcgguccacguucuuccacuacaccaacgacaccgagcccaagaugcgccuggucaucuggcucuacacgccccugcggaccaacgggagcggcgacgacuccuucaccgugagcggccgcauccugacccggcccucccaggacuucgaguucgccuuccucaucccgcccaccguggagacgaagaccacccccuucagcguccccggguucuccgugcaggagaugagcaacucccgcuggccggccgcgaucagcgccauggugguccggggcaacgagccccaggugguccaguuccagaacgggcgcgcccaccuggacggcaugcugcucggcaccacgcccgugucccccaacuacaucgccagcuaccgggggaucagcaccggcaacucccgcagcgccuccagcgaggcggacgagcgggccgugggguccuucgacgucugggugcgccugcaggagccggacggccagcccuacgacaucuucgggaagcagcccgccccgaucggcacccccgacuucaaggccgugaucgucggcuucgccgcgcggccccugaccagcggguccuacgccaacgaggccuacgugaacacgaccgccagcgacuacgcgcccgccaccggcaacaugcgcuucaccgugcggaacgggggcacggggcacaucuccgccaacaaguacugggaguucaagagcuucggcgucgagggcgaggggcacaccaacauccaguaccaggaguacgagcucccggacuacuccggccagguggccagcaaccacaaccuggccccgcccguggcgccccgcaugcccggggagucccugcuccuguuccagagcuccaugcccgucugggacgacggccacggggagagcacccccaagaagauccacugccugcucccccaggaguucaucggccacuucuucgacaagcaggccccgucccugggcgacgccgcccugcuccgguacgugaaccaggagaccaaccgcgugcuguucgagugcaagcuguaccgggacggguacaucacggucgccgcgagcuccggccuccuggacuucccccuggacggguucuuccgcuucgacagcugggugagcuccuucuacauccucagccccgugggcuccggccaggggcgccgguga

SEQ ID NO: 11199 - RNA, 1653 nt, Artificial Sequence
  derived and/or modified sequence opt1 from VP1__Norovirus_and/or_Norovirus-like__AF195847
augaagauggccagcuccgacgccgcgcccagcgccgacggcgccgggaaccuggugccggagucccagcaggagguccucccccuggcccccguggccggcgcggcccuggccgcccccguggucgggcagaccaacaucaucgacccguggaucaaggagaacuucgugcaggcgccccagggcgaguucaccgugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucacggccgggaaggugcugaucgcggccaucccgcccaacuuccccguggagggcgucagcgccucccaggccacccaguucccccacgugaucaucgacgugcggacccuggaccccguccgccucccccugccggacgugcggagcaccuucuuccacuacacgaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagaccaagacgacccccuucuccgugcccggguucagcguccaggagauguccaacagccgcuggccggcggccaucuccgccaugguggugcggggcaacgagccccaggucgugcaguuccagaacgggcgcgcccaccuggacggcaugcugcucggcaccacccccgucagccccaacuacaucgccagcuaccgggggaucuccacgggcaacagccgcuccgcgagcccggaggccgacgagcgggccgugggguccuucgacguguggauccgccugcaggagcccgacggccagcccuacgacaucuucgggaagcagccggcccccaucggcacccccgacuucaaggccgucaucgugggcuucgcggcccggccccugaccagcggguccuacgccaacgaggccuacgugaacaccacggcgagcgacuacgccccggccaccggcaacaugcgcuucaccguccggaacgggggcuccgggcacaucagcgccaacaaguacugggaguucaaguccuucggcguggagggcgagcgccacaccgacauccaguaccaggaguacgagcuccccgacuacagcggccagguggccuccaaccacaaccuggcgccgcccgucgcgccccggaugcccggggagagccugcuccuguuccaguccaacaugcccgugugggacgacgggcacggcgagagcacgcccaagaagauccacugccugcucccgcaggaguucaucgggcacuucuucgacaagcaggcccccucccugggcgacgccgcccugcuccgcuacgugaaccaggagaccaaccggguccuguucgagugcaagcuguaccgcgacggcuacaucaccguggccgccagcuccgggcuccuggacuucccccuggacggcuucuuccgcuucgacagcugggugagcuccuucuacauccucagccccgucggguccggccagggccggcgcuga

SEQ ID NO: 11200 - RNA, 1653 nt, Artificial Sequence
  derived and/or modified sequence opt1 from VP1__Norovirus_and/or_Norovirus-like__JQ970479
augaagauggccagcuccgacgccgcgcccagcgccgacggcgccgggaaccuggugccggagucccagcaggagguccucccccuggcccccguggccggcgcggcccuggccgcccccguggucgggcagaccaacaucaucgacccguggaucaaggagaacuucgugcaggcgccccagggcgaguucaccgugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucacggccgggaaggugcugaucgcggccaucccgcccaacuuccccguggagggcgucagcgccucccaggccacccaguucccccacgugaucaucgacgugcggacccuggaccccguccgccucccccugccggacgugcggagcaccuucuuccacuacacgaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagaccaagacgacccccuucuccgugcccggguucagcguccaggagauguccaacagccgcuggccggcggccaucuccgccaugguggugcggggcaacgagccccaggucgugcaguuccagaacgggcgcgcccaccuggacggcaugcugcucggcaccacccccgucagccccaacuacaucgccagcuaccgggggaucuccacgggcaacagccgcuccgcgagcuccgaggccgacgagcgggccguggggagcuucgacguguggauccgccugcaggagccggacggccagcccuacgacaucuucgggaagcagcccgccccgaucggcacccccgacuucaaggccgucaucgugggcuucgcggcccggccccugaccuccgggagcuacgccaacgaggccuacgugaacaccacggcguccgacuacgcccccgccaccggcaacaugcgcuucaccguccggaacgggggcaccgggcacaucagcgccaacaaguacugggaguuccgcuccuucggcguggagggcgagcggcacacggacgugcaguaccaggaguacgagcucccggacuacagcgggcaggucgccuccaaccacaaccuggcgccgcccguggcgccccgcaugcccggcgagagccugcuccuguuccaguccaacaugcccgugugggacgacgggcggggcgagagcacccccaagaagauccacugccugcucccccaggaguucaucgggcacuucuucgacaagcaggccccgucccugggcgacgccgcccugcuccgcuacgucaaccaggagaccaaccgcgugcuguucgagugcaagcuguaccgggacggcuacaucaccguggccgccgccagcgggcuccuggacuucccccuggacggcuucuuccgcuucgacuccugggucagcagcuucuacauccucucccccguggggagcggccagggccggcgcuga

SEQ ID NO: 11201 - RNA, 1653 nt, Artificial Sequence
  derived and/or modified sequence opt1 from VP1__Norovirus_and/or_Norovirus-like__FM865412
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggagggcgucagcgccucccaggccacccaguucccccacgugaucaucgacgugcggacccuggaccccguccgccucccccugccggacgugcggagcacguucuuccacuacaccaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagacgaagaccacccccuucuccgugcccggguucagcguccaggagauguccaacagccgcuggccggccgcgaucuccgccaugguggugcggggcaacgagccccaggucgugcaguuccagaacgggcgcgcccaccuggacggcaugcugcucggcaccacgcccgucagccccaacuacaucgccagcuaccgggggaucuccaccggcaacagccgcuccgccagcuccgaggcggacgagcgggccguggggagcuucgacguguggguccgccugcaggagccggacggccagcccuacgacaucuucgggaagcagcccgccccgaucggcacccccgacuucaaggccgugaucgugggcuucgccgcgcggccccugaccuccgggagcuacgccaacgaggccuacgucaacacgaccgccuccgacuacgcgcccgccaccggcaacaugcgcuucaccgugcggaacgggggcacggggcacaucagcgccaacaaguacugggaguucaaguccuucggcguggagggcgagcgccacaccaacauccaguaccaggaguacgagcucccggacuacagcgggcaggucgccuccaaccacaaccuggccccgcccguggcgccccggaugcccggcgagagccugcuccuguuccaguccaacaugcccgugugggacgacgggcacggcgagagcacccccaagaagauccacugccugcucccccaggaguucaucgggcacuucuucgacaagcaggccccgucccugggcgacgccgcccugcuccgcuacgucaaccaggagaccaaccgggugcuguucgagugcaagcuguaccgcgacggcuacaucacgguggccgcgagcuccgggcuccuggacuucccccuggacggcuucuuccgcuucgacagcugggucagcuccuucuacauccucagccccgugggguccggccagggccggcgcuga

SEQ ID NO: 11202 - RNA, 1653 nt, Artificial Sequence
  derived and/or modified sequence opt1 from VP1__Norovirus_and/or_Norovirus-like__AF414426
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggagggcgucagcgccucccaggccacccaguucccccacgugaucaucgacgugcggacccuggaccccguccgccucccccugccggacgugcggagcacguucuuccacuacaccaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagacgaagaccacccccuucuccgugcccggguucagcguccaggagauguccaacagccgcuggccggccgcgaucuccgccaugguggugcggggcaacgagccccaggucgugcaguuccagaacgggcgcgcccaccuggacggcaugcugcucggcaccacgcccgucagccccaacuacaucgccagcuaccgggggaucuccaccggcaacagccgcuccgccagcuccgaggcggacgagcgggccguggggagcuucgacguguggguccgccugcaggagccggacggccagcccuacgacaucuucgggaagcagcccgccccgaucggcacccccgacuucaaggccgugaucgugggcuucgccgcgcggccccugaccuccgggagcuacgccaacgaggccuacgucaacacgaccgccuccgacuacgcgcccgccaccggcaacaugcgcuucaccgugcggaacgggggcacggggcacaucagcgccaacaaguacugggaguucaaguccuucggcguggagggcaagcgccacaccagcauccaguaccaggaguacgagcucccggacuacuccgggcaggucgccagcaaccacaaccuggccccgcccguggcgccccggaugcccggcgagucccugcuccuguuccagagcaacaugcccgugugggacgacgggcacggcgaguccacccccaagaagauccacugccugcucccccaggaguucaucgggcacuucuucgacaagcaggccccgagccugggcgacgccgcccugcuccgcuacgucaaccaggagaccaaccgggugcuguucgagugcaagcuguaccgcgacggcuacaucacgguggccgcguccagcgggcuccuggacuucccccuggacggcuucuuccgcuucgacagcugggucuccagcuucuacauccucucccccguggggagcggccagggccggcgcuga

SEQ ID NO: 11203 - RNA, 1653 nt, Artificial Sequence
  derived and/or modified sequence opt1 from VP1__Norovirus_and/or_Norovirus-like__AF414427
augaagauggccagcuccgacgccgcgcccagcgccgacggcgccgggaaccuggugccggagucccagcaggagguccucccccuggcccccguggccggcgcggcccuggccgcccccguggucgggcagaccaacaucaucgacccguggaucaaggagaacuucgugcaggcgccccagggcgaguucaccgugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucacggccgggaaggugcugaucgcggccaucccgcccaacuuccccguggagggcgucagcgccucccaggccacccaguucccccacgugaucaucgacgugcggacccuggaccccguccgccucccccugccggacgugcggagcaccuucuuccacuacacgaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagaccaagacgacccccuucuccgugcccggguucagcguccaggagauguccaacagccgcuggccggcggccaucuccgccaugguggugcggggcaacgagccccaggucgugcaguuccagaacgggcgcgcccaccuggacggcaugcugcucggcaccacccccgucagccccaacuacaucgccagcuaccgggggaucuccacgggcaacagccgcuccgcgagcaccgaggccgacgagcgggccgugggguccuucgacguguggauccgccugcaggagccggacggccagcccuacgacaucuucgggaagcagcccgccccgaucggcacccccgacuucaaggccgucaucgugggcuucgcggcccggccccugaccagcggguccuacgccaacgaggccuacgugaacacgaccgcgagcgacuacgcccccgccaccggcaacaugcgcuucaccguccggaacgggggcuccgggcacaucagcgccaacaaguacugggaguucaaguccuucggcguggagggcgagcgccacacggacauccaguaccaggaguacgagcucccggacuacagcggccagguggccuccaaccacaaccuggcgccgcccgucgcgccccggaugcccggggagagccugcuccuguuccaguccaacaugcccgugugggacgacgggcacggcgagagcacccccaagaagauccacugccugcucccccaggaguucaucgggcacuucuucgacaagcaggccccgucccugggcgacgccgcccugcuccgcuacgugaaccaggagaccaaccggguccuguucgagugcaagcuguaccgcgacggcuacaucaccguggccgccagcuccgggcuccuggacuucccccuggacggcuucuuccgcuucgacagcugggugagcuccuucuacauccucagccccgucggguccggccagggccggcgcuga

SEQ ID NO: 11204 - RNA, 1653 nt, Artificial Sequence
  derived and/or modified sequence opt1 from VP1__Norovirus_and/or_Norovirus-like__JQ613567
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggagggcgucagcgccucccaggccacccaguucccccacgugaucaucgacgugcggacccuggaccccguccgccucccccugccggacgugcggagcacguucuuccacuacaccaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagacgaagaccacccccuucuccgugcccggguucagcguccaggagauguccaacagccgcuggccggccgcgaucuccgccaugguggugcggggcaacgagccccaggucgugcaguuccagaacgggcgcgcccaccuggacggcaugcugcucggcaccacgcccgucagccccaacuacaucgccagcuaccgggggaucuccaccggcaacagccgcuccgccagcuccgaggcggacgagcgggccguggggagcuucgacguguggguccgccugcaggagccggacggccagcccuacgacaucuucgggaagcagcccgccccgaucggcacccccgacuucaaggccgugaucgugggcuucgccgcgcggccccugaccuccgggagcuacgccaacgaggccuacgucaacacgaccgccuccgacuacgcgcccgccaccggcaacaugcgcuucaccgugcggaacgggggcacggggcacaucagcgccaacaaguacugggaguucaaguccuucggcguggagggcgagcgccacaccgacauccaguaccaggaguacgagcucccggacuacagcgggcaggucgccuccaaccacaaccuggccccgcccguggcgccccggaugcccggcgagagccugcuccuguuccaguccaacaugcccgugugggacgacgggcacggcgagagcacccccaagaagauccacugccugcucccccaggaguucaucgggcacuucuucgaccgccaggccccgucccugggcgacgccgcccugcuccgguacgucaaccaggagaccaaccgcgugcuguucgagugcaagcuguaccgcgacggcuacaucacgguggccgcgagcuccgggcuccuggacuucccccuggacggcuucuuccgguucgacagcugggucagcuccuucuacauccucagccccgugggguccggccagggccgccgguga

SEQ ID NO: 11205 - RNA, 1653 nt, Artificial Sequence
  derived and/or modified sequence opt1 from VP1__Norovirus_and/or_Norovirus-like__KC894731
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggaggucgugagcgccucccaggccacccaguucccccacgugaucaucgacguccggacccuggaccccgugcgccucccccugccggacgugcggagcacguucuuccacuacaccaacgacaccgagcccaagaugcgccuggucaucuggcucuacacgccccugcggaccaacggcuccggggacgacagcuucaccguguccggccgcauccugacccggcccagccaggacuucgaguucgccuuccucaucccgcccaccguggagacgaagaccacccccuucuccguccccggcuucagcgugcaggagauguccaacagccgcuggccggccgcgaucuccgccauggugguccgggggaacgagccccaggugguccaguuccagaacggccgcgcccaccuggacgggaugcugcucggcaccacgcccgugagccccaacuacaucgccagcuaccggggcaucuccaccgggaacagccgcuccgccagcccggaggcggacgagcgggccgugggcuccuucgacgucugggugcgccugcaggagcccgacgggcagcccuacgacaucuucggcaagcagccggcccccaucgggacccccgacuucaaggccgugaucgucggcuucgccgcgcggccccugaccagcggcuccuacgccaacgaggccuacgugaacacgaccgccagcaacuacgcgccggccaccgggaacaugcgcuucaccgugcggaacggcgggacgggccacaccuccgccaacaaguacugggaguucaagagcuucggggucgagggcgagcgccacaccggcauccaguaccaggaguacgagcuccccgacuacuccggccagguggccagcaaccacaaccuggccccgcccguggcgccccggaugcccggggagucccugcuccuguuccagagcaacaugcccgucugggacgacgggcacggcgaguccacccccaagaagauccacugccugcucccgcaggaguucaucgggcacuucuucgacaagcaggcccccagccugggcgacgccgcccugcuccgcuacgugaaccaggagacgaaccgggugcuguucgagugcaagcuguaccgcgacggcuacaucaccgucgccgcguccagcgggcuccuggacuucccccuggacggcuucuuccgcuucgacuccugggugagcagcuucuacauccucucccccguggggagcggccagggccggcgcuga

SEQ ID NO: 11206 - RNA, 1647 nt, Artificial Sequence
  derived and/or modified sequence opt1 from VP1__Norovirus_and/or_Norovirus-like__AF427118
augaagauggccagcaacgacgccgcgcccuccagcgacggcgccgccgggcuggugccggaguccaacaacgaggucauggcccucgagcccguggccggcgcgagccuggccgcccccgugaccgggcagaccaacaucaucgaccccuggauccgcaugaacuucguccaggccccgaacggcgaguucacggugagcccccggaacucccccggggaggugcugcucaaccuggagcugggccccgagcucaacccguaccuggcgcaccugucccgcauguacaacggcuacgccgggggcauggagguccagaucaugcucgccgggaacgccuucaccgccggcaagcugaucuucgcggccgugccgccccacuuccccaucgagaaccugagcccgccccagaucaccauguucccccacgugaucaucgacguccggacccucgagcccgugcugcugcccaugcccgacauccgcaacuccuucuuccacuucauccagcgggacgagcccaagaugcgccucguggccaugcuguacacgccccugcggagcaacggguccggcgacgacgucuucaccgugagcugccgcgugcucacccggccgacccccgacuucgacuucacguaccuggucccgcccaccguggaguccaagagcaagcccuucacccugcccauccucacccugggcgagcugacgaacucccgcuucccccuccccaucgacgugcuguacaccaacccgaacgagagcgccaucguccagugccagaacgggcggugcacccuggacggcgagcuccaggggaccacgcagcugcugcccaccggcaucugcgccuuccgcggcaaggugacccagcagguccaggacgagcaccgggggacccacuggaacaugacggugaccaaccucaacggcacccccuucgacccgaccgaggacgugcccgcgccccuggggacgcccgacuucuccggccagaucuacggggugaucagccagcgcaacaccaacaccgucccgggcgagggcgaccugcccgccaaccgggcccacgaggccgugaucgccaccuacucccccaaguucacgcccaagcucgggaacauccaguucagcaccugggagacccaggacgucagcuccggccagccgaccaaguucacgcccguggggcuggcgagcguggacgccaacucccacuucgaccaguggacccugcccagcuacuccggcgcccucacccugaacaugaaccuggcccccagcgucgccccgguguuccccggggagugccuccuguucuuccgcuccuucaucccccugaagggcggcuacgggaaccccgcgaucgacugccucaugccgcaggagugggugcagcaccuguaccaggagagcgcccccucccugagcgacgucgcccucgugcgguacgugaaccccgagaccggccgcacgcuguucgaggccaagcugcaccggaacggguuccucaccgucgcgcgcaacuccgccggccccgugguggccccgaccaacggguacuuccgguucgacagcugggucaaccaguucuacacccuggcccccaugggcaacggcuccgggcgccgccggaugcaguga

SEQ ID NO: 11207 - RNA, 1647 nt, Artificial Sequence
  derived and/or modified sequence opt1 from VP1__Norovirus_and/or_Norovirus-like__AY237415
augaagauggccagcaacgacgccgcgcccuccagcgacggcgccgccgggcuggugccggaguccaacaacgaggucauggcccucgagcccguggccggcgcgagccuggccgcccccgugaccgggcagaccaacaucaucgaccccuggauccgcaugaacuucguccaggccccgaacggcgaguucacggugagcccccggaacucccccggggaggugcugcucaaccuggagcugggccccgagcucaacccguaccuggcgcaccugucccgcauguacaacggcuacgccgggggcauggagguccagaucaugcucgccgggaacgccuucaccgccggcaagcugaucuucgcggccgugccgccccacuuccccaucgagaaccugagcccgccccagaucaccauguucccccacgugaucaucgacguccggacccucgagcccgugcugcugcccaugcccgacauccgcaacuccuucuuccacuucauccagcgggacgagcccaagaugcgccucguggccaugcuguacacgccccugcggagcaacggguccggcgacgacgucuucaccgugagcugccgcgugcucacccggccgacccccgacuucgacuucacguaccuggucccgcccaccguggaguccaagagcaagcccuucacccugcccauccucacccugggcgagcugacgaacucccgcuucccccuccccaucgacgugcuguacaccaacccgaacgagagcgccaucguccagugccagaacgggcggugcacccuggacggcgagcuccaggggaccacgcagcugcugcccaccggcaucugcgccuuccgcggcaaggugacccagcagguccaggacgagcaccgggggacccacuggaacaugacggugaccaaccucaacggcacccccuucgacccgaccgaggacgugcccgcgccccuggggacgcccgacuucuccggccagaucuacggggugaucagccagcgcaacaccaacaccgucccgggcgagggcaaccugcccgccaaccgggcccacgaggccgugaucgccaccuacucccccaaguucacgcccaagcucgggaacauccaguucagcaccugggagacccaggacgucagcuccggccagccgaccaaguucacgcccguggggcuggcgagcguggacgccaacucccacuucgaccaguggacccugcccagcuacuccggcgcccucacccugaacaugaaccuggcccccagcgucgccccgguguuccccggggagugccuccuguucuuccgcuccuucaucccccugaagggcggcuacgggaaccccgcgaucgacugccucaugccgcaggagugggugcagcaccuguaccaggagagcgcccccucccugagcgacgucgcccucgugcgguacgugaaccccgagaccggccgcacgcuguucgaggccaagcugcaccggaacggguuccucaccgucgcgcgcaacuccgccggccccgugguggccccgaccaacggguacuuccgguucgacagcugggucaaccaguucuacacccuggcccccaugggcaacggcuccgggcgccgccggaugcaguga

SEQ ID NO: 11208 - RNA, 1647 nt, Artificial Sequence
  derived and/or modified sequence opt1 from VP1__Norovirus_and/or_Norovirus-like__AF504671
augaagauggccagcaacgacgccgcgcccuccaacgacggcgccgccgggcuggugccggagagcaacaacgaggucauggcccucgagcccguggccggcgcgucccuggccgcccccgugaccgggcagaccaacaucaucgaccccuggauccgcaugaacuucguccaggccccgaacggcgaguucacggugagcccccggaacucccccggggaggugcugcucaaccuggagcugggccccgagcucaacccguaccuggcgcaccugagccgcauguacaacggcuacgccgggggcauggagguccagaucaugcucgccgggaacgccuucaccgccggcaagcugaucuucgcggccgugccgccccacuuccccaucgagaaccuguccccgccccagaucaccauguucccccacgugaucaucgacguccggacccucgagcccgugcugcugcccaugcccgacauccgcaacagcuucuuccacuucauccagcgggacgagcccaagaugcgccucguggccaugcuguacacgccccugcgguccaacgggagcggcgacgacgucuucaccguguccugccgcgugcucacccggccgacccccgacuucgacuucacguaccuggucccgcccaccguggagagcaaguccaagcccuucacccugcccauccucacccugggcgagcugacgaacagccgcuucccccuccccaucgacgugcuguacaccaacccgaacgaguccgccaucguccagugccagaacgggcggugcacccuggacggcgagcuccaggggaccacgcagcugcugcccaccggcaucugcgccuuccgcggcaaggugacccagcagguccaggacgagcaccgggggacccacuggaacaugacggugaccaaccucaacggcacccccuucgacccgaccgaggacgugcccgcgccccuggggacgcccgacuucagcggccagaucuacggggugaucucccagcgcaacaccaacaccgucccgggcgagggcaaccugcccgccaaccgggcccacgaggccgugaucgccaccuacagccccaaguucacgcccaagcucgggaacauccaguucuccaccugggagacccaggacgucagcagcggccagccgaccaaguucacgcccguggggcuggcguccguggacgccaacagccacuucgaccaguggacccugcccuccuacagcggcgcccucacccugaacaugaaccuggcccccuccgucgccccgguguuccccggggagugccuccuguucuuccgcagcuucaucccccugaagggcggcuacgggaaccccgcgaucgacugccucaugccgcaggagugggugcagcaccuguaccaggaguccgcccccagccuguccgacgucgcccucgugcgguacgugaaccccgagaccggccgcacgcuguucgaggccaagcugcaccggaacggguuccucaccgucgcgcgcaacagcgccggccccgugguggccccgaccaacggguacuuccgguucgacuccugggucaaccaguucuacacccuggcccccaugggcaacggcagcgggcgccgccggaugcaguga

SEQ ID NO: 11209 - RNA, 1647 nt, Artificial Sequence
  derived and/or modified sequence opt1 from VP1__Norovirus_and/or_Norovirus-like__KJ194504
augaagauggccagcaacgacgccgcgcccuccaacgacggcgccgccgggcuggugccggagaucaacaacgaggccauggcccucgagcccguggcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcuggucgccaugcuguacaccccgcuccgcgccaacaacuccggcgacgacguguucaccgugagcugccggguccugacgcgccccucccccgacuucagcuucaacuuccuggugcccccgaccguggaguccaagaccaagcccuucacccuccccauccugacgaucagcgagauguccaacagccgguuccccgucccgaucgacucccugcacaccagccccaccgagaacaucguggugcagugccagaacgggcgcgucacccucgacggcgagcugauggggacgacccagcugcuccccucccagaucugcgccuuccggggcacccugacccgcagcacgucccgggcgagcgaccaggccgacacccccaccccgcgccaguucgaccaccgguggcacauccagcuggacaaccucaacggcacccccuacgaccccgccgaggacaucccggcgccccuggggacgcccgacuuccgcggcaagguguucgggguggccagccagcggaaccccgacggcaccacccgcgcccacgaggccaaggucgacaccacgaccaaccgguucaccccgaagcuggggucccucgagaucaucaccgagagcgaggacuucgacacgaaccaguccaccaaguucacccccgugggcgucggcguggacaacgaggaggaguuccagcaguggagccugcccaacuacuccgggcaguucacccacaacaugaaccuggcccccgccguggcgccgaacuuccccggcgagcagcuccuguucuuccgcagccagcugcccuccagcgggggcugguccaacgggauccucgacugccuggucccccaggagugggugcagcacuucuaccaggagagcgccccggcccagacccagguggcccugguccgguacgugaaccccgacacgggccgcguccucuucgaggccaagcugcacaagcugggcuucaugaccaucgcgaagaacggggacucccccaucaccgugcccccgaacggcuacuuccgcuucgagagcugggugaaccccuucuacacgcucgcccccauggggaccggcaacgggcggcgccggauccaguga

SEQ ID NO: 11210 - RNA, 1647 nt, Artificial Sequence
  derived and/or modified sequence opt1 from VP1__Norovirus_and/or_Norovirus-like__KJ194500
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucagccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagagcuccgagagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacggccgcgugacccucgacggggagcugaugggcacgacccagcugcuccccucccagaucugcgccuuccgggggacccugaccggcagcacgagccgcgcguccgaccagaccgacacccccaccccgcggcaguucgaccgccgguggcacauccagcuggacaaccucaacggcacgcccuacgaccccgccgaggacaucccggcgccccuggggacccccgacuuccgcggcaaggucuucgggguggccagccagcggaaccccgaccgcgccacccgggcccacgaggccaagguggacaccacguccgaccgcuucgccccgaagcugggcagccucgagaucaccaccgaguccggggacuucgaggccaaccagcccaccaaguucacgcccgucggcaucggcguggacaacgaggcggaguuccagcaguggagccugcccaacuacuccgggcagaucacccacaacaugaaccuggccccggccgucgcccccaacuuccccggcgagcagcuccuguucuuccggagccagcugcccuccagcgggggcugguccaacggggugcucgacugccugcugccgcaggagugggugcagcacuucuaccaggagagcgcccccgcgcagacccaggucgcccucgugcgcuacgugaaccccgacaccggccgcguccuguucgaggccaagcugcacaagcucggcuucaugacgaucgccaagaacggggacucccccaucaccgugccgcccaacggcuacuuccgguucgagagcugggugaaccccuucuacacccuggcccccauggggaccggcaacgggcgccggcgcauccaguga

SEQ ID NO: 11211 - RNA, 1647 nt, Artificial Sequence
  derived and/or modified sequence opt1 from VP1__Norovirus_and/or_Norovirus-like__DQ093063
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgaguccgucguggugcagugccagaacgggcgcgucacccucgacggcgagcugauggggacgacccagcugcuccccagccagaucugcgccuuccggggcacccugacccgccccacgaaccgggcguccgaccaggccgacaccgccaccccgcgccuguucaaccaccaguggcacauccagcucgacaaccugaacggcacccccuacgaccccgccgaggacaucccggcgccccuggggacgcccgacuuccggggcaagguguucgggguggccagccagcgcgaccccgacggcaccacccgggcccacgaggccaaggucgacaccacgagcgggcgcuucaccccgaagcucggcucccuggagaucaccaccgagagcgacgacuucaaccagaacaagcccacgcgguucacccccgugggcaucggggucgacaacgaggccgacuuccagcaguggauccugcccgacuacuccggccaguucacccacaacaugaaccucgcgccggccguggcccccaacuuccccggggagcagcugcuguucuuccgcagccagcuccccuccagcggcgggcgguccaacggcauccuggacugccuggugccgcaggaguggguccagcacuucuaccaggagagcgcccccgcccagacccagguggcgcucgugcgcuacgucaaccccgacacgggccgcgugcuguucgaggccaagcugcacaagaugggguucaugaccaucgccaagaacggcgacucccccaucaccgugccgcccaacggguacuuccgguucgagagcugggucaaccccuucuacacccucgcccccaugggcacggggaagggccgccggcgcauccaguga

SEQ ID NO: 11212 - RNA, 1647 nt, Artificial Sequence
  derived and/or modified sequence opt1 from VP1__Norovirus_and/or_Norovirus-like__AY030313
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgaguccaucgucgugcagugccagaacgggcgcgugacccucgacggcgagcugauggggacgacccagcugcuccccaaccagaucugcgccuuccggggcacccugacccgcagcacgaaccgggcguccgaccaggccgacaccgccacgccccgccuguucgaccaccacuggcacauccagcucgacaaccugaacggcaccccguacgaccccgccgaggacauccccgccccgcuggggacccccgacuuccggggcaaggucuucgggguggcgagccagcgcaaccccgacagcaccacccgggcccacgaggccaagguggacaccacguccggccgcuucacccccaagcucgggagccuggagaucaccaccgaguccgacgacuucgacccgaaccagagcacgaaguucacccccgucggcaucggcguggacaacgaggccgacuuccagcaguggucccugcccgacuacagcgggcaguucacccacaacaugaaccucgcgcccgccgucgccccgaacuuccccggcgagcagcugcuguucuuccggucccagcuccccagcuccgggggccgcagcaacgggauccuggacugccuggugccccaggagugggugcagcacuucuaccaggaguccgccccggcccagacccaggucgcgcucgugcgguacgugaaccccgacacgggccgcguccuguucgaggccaagcugcacaagcucggcuucaugaccaucgccaagaacggggacagccccaucaccgugcccccgaacggcuacuuccgcuucgaguccugggugaaccccuucuacacccuggcccccauggggacgggcaacgggcggcgccggauccaguga

SEQ ID NO: 11213 - RNA, 1647 nt, Artificial Sequence
  derived and/or modified sequence opt1 from VP1__Norovirus_and/or_Norovirus-like__U02030
augaagauggccagcaacgacgccgcgcccuccaacgacggcgccgccugccuggugccggagaucaacaacgaggccauggcccucgagcccgucgcggggagcgccaucgccgcgccccugaccggccagcagaacaucaucgaccccuggaucaugaacaacuucgugcaggcccccgggggcgaguucaccgugagcccccgcaacucccccggggagguccugcucaaccuggagcugggccccgagaucaacccguaccucgcccaccuggcccggauguacaacggcuacgccgggggcuucgagguccagguggugcuggccgggaacgcguucacggccggcaagaucaucuucgccgccaucccgcccaacuuccccaucgacaaccucuccgccgcgcagaucaccaugugcccgcacgugaucguggacguccgccagcuggagcccaucaaccugcccaugcccgacgugcggaacaacuucuuccacuacaaccaggggagcgacucccgccuccggcugaucgccaugcuguacaccccgcuccgcgccaacaacagcggcgacgacguguucaccgucuccugccgggugcugacgcgccccagccccgacuucuccuucaacuuccuggugcccccgaccgucgagagcaagaccaagcccuucacccuccccauccugacgaucuccgagaugagcaacucccgguuccccgugccgaucgacagccugcacaccucccccaccgagaacaucgugguccagugccagaacggccgcgugacccucgacggggagcugaugggcacgacccagcugcuccccagccagaucugcgccuuccgggggacccugacccgcuccacgagccgggccagcgaccaggcggacacccccaccccgcgccuguucaacuacuacuggcacauccagcucgacaaccugaacggcacccccuacgaccccgccgaggacaucccggcgccccugggcacgcccgacuuccgggggaagguguucggcgucgccucccagcgcaaccccgacagcaccacccgggcccacgaggccaagguggacaccacguccgggcgcuucaccccgaagcucggcagccuggagaucaccaccgaguccgacgacuucgaccccaaccagcccacgaaguucacccccgugggggucggcguggacaacgaggccgaguuccagcaguggagccugccgaacuacuccggccaguucacccacaacaugaaccucgcccccgccgucgcgcccaacuuccccggggagcagcugcuguucuuccggagccagcucccguccagcggcgggcgcuccaacggcgugcuggacugccuggugccccaggaguggguccagcacuucuaccaggagagcgcccccgcccagacccagguggcccucgugcgguacgucaaccccgacacggggcgcgugcuguucgaggccaagcugcacaagcucggcuucaugaccaucgcgaagaacggcgacuccccgaucaccgugccgcccaacggguacuuccgcuucgagagcugggucaaccccuucuacacccuggcccccaugggcacggggaacggccggcgccggauccaguga

SEQ ID NO: 11214 - RNA, 1647 nt, Artificial Sequence
  derived and/or modified sequence opt1 from VP1__Norovirus_and/or_Norovirus-like__AB039782
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcuguucacccugcccauccugacgaucagcgagauguccaacagccgguuccccgugcccaucgacucccuccacaccagcccgaccgagaacaucgucgugcagugccagaacgggcgcgugacccuggacggcgagcugauggggacgacccagcuccugcccucccagaucugcgccuuccggggcacccugacccgcagcacgucccgggcgagcgaccaggccgacacccccacgccccgccucuucaaccaccgguggcacauccagcuggacaaccugaacggcaccccguacgaccccgccgaggacauccccgccccgcucgggacgcccgacuuccgcggcaaggucuucgggguggccagccagcggaaccccgacuccaccacccgcgcgcacgaggccaagguggacaccacgagcggccgguucacccccaagcuggggucccuggagaucaccaccgagagcgacgacuucgacacgaaccaguccaccaaguucaccccggucggcaucggcguggacaacgaggccgaguuccagcaguggagccuccccaacuacuccgggcaguucacccacaacaugaaccuggcccccgcggucgcccccaacuucccgggcgagcagcuccucuucuuccgcagccagcugcccuccagcgggggccgguccaacggggugcuggacugccucgugccccaggaguggguccagcacuucuaccaggagagcgcccccgcccagacccagguggcccuggugcgcuacgucaacccggacaccggccgcgugcuguucgaggcgaagcuccacaagcugggcuucaugaccaucgccaagaacggggacucccccaucaccgugccgcccaacggcuacuuccgguucgagagcugggucaaccccuucuacacgcuggcccccauggggaccggcaacgggcgccggcgcauccaguga

SEQ ID NO: 11215 - RNA, 1647 nt, Artificial Sequence
  derived and/or modified sequence opt1 from VP1__Norovirus_and/or_Norovirus-like__U46039
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguucaccccgcuccgcgccaacaacuccggcgacgacgucuucaccgugagcugccgggugcugacgcgccccucccccgacuucagcuucaacuuccuggugcccccgaccguggaguccaagaucaagcccuucacccuccccauccugcccaucagcgagauguccaacagccgguucccggugcccaucgacucccugcacaccagccccacggagaacaucgucgugcagugccagaacgggcgcgugacccucgacggcgagcugauggggaccacccagcuguuccccucccagaucugcgccuuccggggcacgcucacccgcagcaccucccgggcgagcgaccaggccgacaccagcacgccgcgccuguucaacuacuacuggcacauccagcuggacaaccucaacggcacccccuacgaccccgccgaggacaucccggcgccccuggggacccccgacuuccagggcaaggucuucgggguggccucccagcggaaccccgacagcaccacgcgcgcccacgaggccaagguggacaccaccuccggccgguucaccccgaagcuggggagccucgagaucuccacggagagcgacgacuucgacuccaaccagcccaccaaguucacccccgucggcaucggcguggacaacgaggccgacuuccagcaguggagccugcccaacuacuccgggcaguucacccacaacaugaaccuggccccggcggucgcccccaucuuccccggcgagcagauccucuucuuccgcagccaggugcccuccagcgggggccgguccaacggggugcuggacugccuggucccgcaggagugggugcagcacuucuaccaggagagcgcccccgcccagacccagguggcccucguccgcuacgugaaccccgacacgggccgggugcuguucgaggcgaagcugcacaagcucggcuucaugaccaucgccaagaacggggacucccccaucaccgucccgcccaacggcuacuuccgcuucgagagcugggugaaccccuucuacacgcuggcccccauggggaccggcaacgggcgccggcgcauccaguga

SEQ ID NO: 11216 - RNA, 1647 nt, Artificial Sequence
  derived and/or modified sequence opt1 from VP1__Norovirus_and/or_Norovirus-like__DQ093066
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcaccuuccggggcacccugacgcgcagcaccucccgggccagcgaccaggcggacaccgccacgccccgccuguucaacuacuacuggcacauccagcucgacaaccugaacggcaccccguacgaccccgccgaggacauccccgccccgcuggggacccccgacuuccggggcaaggucuucgggguggccagccagcgcaaccccgacuccaccacccgggcgcacgaggccaagguggacacgaccagcggccgcuucauccccaagcucgggucccuggagaucagcaccgaguccgacgacuucgaccagaaccagccgacccgguucacgcccgucggcaucggcguggacaacgaggccggguuccagcaguggagccugcccgacuacuccggccaguucacccacaacaugaaccucgcccccgcggucgccccgaacuuccccggggagcagcugcuguucuuccgcagccagcuccccuccagcggcgggcgguccaacggcauccuggacugccuggugccccaggagugggugcagcacuucuaccaggagagcgccccggcccagacccaggucgcccucgugcgcuacgugaaccccgacaccggccgcguccuguucgaggcgaagcugcacaagcucggguucaugacgaucuccaagaacggcgacagccccaucaccgugcccccgaacggguacuuccgguucgaguccugggugaaccccuucuacacccuggcccccaugggcaccgggaacggccgccggcgcauccaguga

SEQ ID NO: 11217 - RNA, 1647 nt, Artificial Sequence
  derived and/or modified sequence opt1 from VP1__Norovirus_and/or_Norovirus-like__DQ093062
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcuguucacccugcccauccugacgaucagcgagauguccaacagccgguuccccgugcccaucgacucccuccacaccagcccgaccgagaacaucgucgugcagugccagaacgggcgcgugacccuggacggcgagcugauggggacgacccagcuccugcccucccagaucugcgccuuccggggcacccugacccgccccacgagccgggcguccgaccaggccgacacccccaccccgcgccucuucaaccaccgguggcacauccagcuggacaaccugaacggcacccccuacgaccccgccgaggacaucccggcgccccucgggacgcccgacuuccgcggcaaggucuucgggguggccagccagcggaaccccgacagcaccacccgcgcccacgaggccaagguggacaccacguccggccgguucaccccgaagcuggggagccuggagaucaccaccgaguccgacgacuucgacacgaaccagagcaccaaguucacccccgucggcaucggcguggacaacgaggccgaguuccagcaguggucccuccccaacuacagcgggcaguucacccacaacaugaaccuggcccccgcggucgccccgaacuuccccggcgagcagcuccucuucuuccgcucccagcugcccagcuccgggggccggagcaacggggugcuggacugccucgugccccaggaguggguccagcacuucuaccaggaguccgccccggcccagacccagguggcccuggugaaguacgucaaccccgacacgggccgcgugcuguucgaggcgaagcuccacaagcugggcuucaugaccaucgccaagaacggggacagccccaucaccgugcccccgaacggcuacuuccgcuucgaguccugggucaaccccuucuacacgcuggcccccauggggaccggcaacgggcggcgccggauccaguga

SEQ ID NO: 11218 - RNA, 1647 nt, Artificial Sequence
  derived and/or modified sequence opt1 from VP1__Norovirus_and/or_Norovirus-like__GU930737
augaagauggccagcaacgacgccgcgcccuccaacgacggcgccgccaaccuggugccggaggccaacagcgaggucauggcccucgagcccguggugggggcguccaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucagccaccugucccgcauguacaacggcuacgcgggcgggaugcagguccagguggugcuggccggcaacgccuucaccgccgggaagaucaucuucgccgcggugccgccccacuuccccguggagaacaucagcgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagaccaagcccuucacgcuccccauccugacccugggggagcucagcaacucccgguucccggcccccaucgacaugcuguacaccgaccccaacgaggccaucguggugcagccccagaacggccgcugcacccuggacggcacgcuccaggggaccacccagcuggucccgacccagaucugcagcuuccggggcacgcugaucucccagaccagccgcuccgccgacagcaccgacuccgcgccccgggugcgcaaccacccccuccacguccagcugaagaaccuggacgggaccccguacgaccccacggacgaggugcccgccgugcucggcgccaucgacuucaagggcaccgucuucgggguggccagccagcggaacaccaccggcaacagcgaggagggggccacgcgcgcccacgaggugcacaucgacaccaccaacccccgguacaccccgaagcugggcuccgucuucaugcacagcgaguccacggacuucgacgacgggcagcccacccgcuucacccccaucggcaugggcgcggacgacuggcggcagugggagcugcccgaguacagcgggcaccucacccugaacaugaaccuggccccggccguggcccccgcguuccccggcgagcgcauccucuucuuccgcuccgugguccccagcgccgggggcuacggguccggccagaucgacugccugaucccgcaggagugggugcagcacuucuaccaggaggccgcccccagccaguccgccguggcgcugauccgguacgucaaccccgacacgggccgcaacaucuucgaggccaagcuccaccgggagggguucaucaccguggccaacagcggcaacaaccccaucguggucccgcccaacggguacuuccgcuucgaggccugggugaaccaguucuacacccugacccccaugggcacggggcagggccggcgccgggugcaguga

SEQ ID NO: 11219 - RNA, 1647 nt, Artificial Sequence
  derived and/or modified sequence opt1 from VP1__Norovirus_and/or_Norovirus-like__AF414412
augaagauggccagcaacgacgccgcgcccuccagcgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucuccgcggcccagaucaccaugugcccccacgugaucgucgacgugcgccagcuggagcccaucaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcuguucacccugcccauccugacgaucuccgagaugagcaacucccgguuccccgugcccaucgacagccuccacaccuccccgaccgagaacaucgucgugcagugccagaacgggcgcgugacccuggacggcgagcugauggggacgacccagcuccugcccagccagaucugcgccuuccggggcacccugacccgcuccacgagccgggcgagcgaccaggccgacacccccacgccccgccucuucaacuacuacuggcacauccagcuggacaaccugaacggcaccccguacgaccccgccgaggacauccccgccccgcucgggacccccgacuuccggggcaaggucuucgggguggccucccagcgcaaccccgacagcaccacccgggcgcacgaggccaagguggacaccacguccggccgcuucacccccaagcuggggagccuggagaucuccaccgagagcgacgacuucgacccgaaccagcccaccaaguucacgcccgucggcaucggcguggacaacgaggccgacuuccagcaguggucccuccccaacuacagcgggcaguucacccacaacaugaaccuggccccggcggucgcccccaacuuccccggcgagcagcuccucuucuuccggucccagcgccccagcuccgggggccggagcaacgggauccuggacugccuggugccgcaggagugggugcagcacuucuaccaggaguccgcccccgcccagacccaggucgcccucgugcgcuacgugaaccccgacaccggccgcguccuguucgaggcgaagcugcacaagcucggcuucaugacgaucgccaagaacggggacagccccaucaccgugccgcccaacggcuacuuccgguucgaguccugggugaaccccuucuacacccuggcccccauggggaccggcaacgggcgccggcgcauccaguga

SEQ ID NO: 11220 - RNA, 1647 nt, Artificial Sequence
  derived and/or modified sequence opt1 from VP1__Norovirus_and/or_Norovirus-like__AB039781
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcuguucacccuccccauccugacgaucagcgagauguccaacagccgguuccccgugcccaucgacucccuccacaccagcccgaccgagaacaucgucgugcagugccagaacgggcgcgugacccuggacggcgagcugaugggggccacgcagcuccugcccucccagaucugcgcguuccggggcacccugacccgcagcaccucccgggccagcgaccagacggacacccccacgccccgccucuucaaccaccgguggcacauccagcuggacaaccugaacggcaccccguacgaccccgccgaggacauccccgccccgcucgggacgcccgacuuccgcggcaaggucuucgggguggccagccagcggaaccccgacuccaccacccgcgcgcacgaggccaagguggacaccacgagcggccgguucacccccaagcuggggucccuggagaucaccaccgagagcgacgaccucgacacgaaccaguccaccaaguucaccccggucggcaucggcguggacaacgaggccgaguuccagcaguggagccugcccaacuacuccgggcaguucacccacaacaugaaccuggcccccgcggucgcccucaacuuccccggcgagcagcugcuguucuuccgcagccagcucccguccagcgggggccgguccaacggggugcuggacugccuggugccccaggaguggguccagcacuucuaccaggagagcgcccccgcccagacccagguggcccucgugcgcuacgucaaccccgacaccggccgcgugcuguucgaggcgaagcugcacaagcucggcuucaugaccaucgccaagaacggggacuccccgaucaccgugccgcccaacggcuacuuccgguucgagagcugggucaaccccuucuacacgcuggcccccauggggaccggcaacgggcgccggcgcauccaguga

SEQ ID NO: 11221 - RNA, 1647 nt, Artificial Sequence
  derived and/or modified sequence opt1 from VP1__Norovirus_and/or_Norovirus-like__LC035073
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgaguucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacgagcgggcgcuucacccccaagcucggcucccuggagaucagcaccgaguccgacgacuucgaccagaaccagccgacccgguucacgcccgugggcaucggggucgaccacgaggccgacuuccagcaguggagccugcccgacuacuccggccaguucacccacaacaugaaccucgcccccgccguggcgccgaacuuccccggggagcagcugcuguucuuccgcagccagcuccccuccagcggcgggcgguccaacggcauccuggacugccuggugccccaggaguggguccagcacuucuaccaggagagcgccccggcccagacccagguggcccucgugcgcuacgucaaccccgacaccggccgcgugcuguucgaggccaagcugcacaagcucggguucaugacgaucgcgaagaacggcgacucccccaucaccgugcccccgaacggguacuuccgguucgagagcugggucaaccccuucuacacccuggcccccaugggcaccgggaacggccgccggcgcgugcaguga

SEQ ID NO: 11222 - RNA, 1647 nt, Artificial Sequence
  derived and/or modified sequence opt1 from VP1__Norovirus_and/or_Norovirus-like__AF539440
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacggccgggcgcuucacccccaagcucggcagccuggagaucuccaccgagagcgacgacuucgaccagaaccagccgacccgguucacgcccgugggcgucgggguggaccacgaggccgacuuccagcaguggucccugcccgacuacagcggccaguucacccacaacaugaaccucgcccccgcgguggccccgaacuuccccggggagcagcugcuguucuuccgcucccagcuccccagcuccggcgggcggagcaacggcauccuggacugccuggucccccaggagugggugcagcacuucuaccaggaguccgccccggcccagacccagguggcccucguccgcuacgugaaccccgacaccggccgcgugcuguucgaggcgaagcugcacaagcucggguucaugacgaucgccaagaacggcgacagccccaucaccgugcccccgaacggguacuuccgguucgaguccugggucaaccccuucuacacccuggcccccaugggcaccgggaacggccgccggcgcauccaguga

SEQ ID NO: 11223 - RNA, 1647 nt, Artificial Sequence
  derived and/or modified sequence opt1 from VP1__Norovirus_and/or_Norovirus-like__AF414414
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcuguucacccuccccauccugacgaucagcgagauguccaacagccgguuccccgugcccaucgacucccuccacaccagcccgaccgagaacaucgucgugcagugccagaacgggcgcgugacccuggacggcgagcugauggggacgacccagcuccugcccucccagaucugcgccuuccggggcacccugacccgcagcacgucccgggcgagcgaccaggccgacacccccacgccccgccucuucaaccaccgguggcacauccagcuggacaaccugaacggcaccccguacgaccccgccgaggacauccccgccccgcucgggacccccgacuuccgcggcaaggucuucgggguggccagccagcggaaccccgacuccaccacccgcgcgcacgaggccaagguggacaccacgagcggccgguucacccccaagcuggggucccuggagaucaucaccgagagcgacgacuucgacaccaaccaguccacgaaguucaccccggucggcaucggcguggacaacgagagcgaguuccagcaguggucccuccccaacuacagcgggcaguucacccacaacaugaaccuggcccccgccgucgcgcccaacuuccugggcgagcagcuccuguucuuccgcucccagcugccgagcuccgggggccggagcaacggggugcucgacugccuggugccccaggaguggguccagcacuucuaccaggaguccgcccccgcccagacccagguggcccuggugcgcuacgucaaccccgacacgggccgcguccucuucgaggccaagcugcacaagcugggcuucaugaccaucgcgaagaacggggacagcccgaucaccgugccgcccaacggcuacuuccgguucgaguccugggugaaccccuucuacacccucgcccccauggggacgggcaacgggcgccggcgcauccaguga

SEQ ID NO: 11224 - RNA, 1647 nt, Artificial Sequence
  derived and/or modified sequence opt1 from VP1__Norovirus_and/or_Norovirus-like__AB190457
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacggccgggcgcuucacccccaagcucggcagccuggagaucuccaccgagagcggcgacuucgaccagaaccagccgacccgguucacgcccguggggaucggcgucgacaacgaggccgacuuccagcaguggucccugcccgacuacagcgggcaguucacccacaacaugaaccucgcccccgcgguggccccgaacuuccccggcgagcagcugcuguucuuccgcucccagcuccccagcuccgggggccggagcaacggcauccuggacugccuggugccccaggaguggguccagcacuucuaccaggaguccgccccggcccagacccagguggcccucgugcgcuacgucaaccccgacaccgggcgcgugcuguucgaggcgaagcugcacaagcucggcuucaugacgaucgccaagaacggggacagccccaucaccgugcccccgaacggcuacuuccgguucgaguccugggucaaccccuucuacacccuggcccccauggggaccggcaacggccgccggcgcauccaguga

SEQ ID NO: 11225 - RNA, 1647 nt, Artificial Sequence
  derived and/or modified sequence opt1 from VP1__Norovirus_and/or_Norovirus-like__AF425768
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugagcggcaccccguacgaccccgccgaggacauccccgggccgcugggcacccccgacuuccgggggaagguguucggcguggccucccagcgcaaccccgacagcaccacccgggcccacgaggcgaaggucgacaccacggccgggcgcuucacccccaagcucggcucccuggagaucagcaccgaguccgacgacuucgaccagaaccagccgacccgguucacgcccgugggcgucgggguggaccacgaggccgacuuccagcaguggagccugcccgacuacuccggccaguucacccacaacaugaaccucgcccccgcgguggccccgaacuuccccggggagcagcugcuguucuuccgcagccagcuccccuccagcggcgggcgguccaacggcauccuggacugccuggucccccaggagugggugcagcacuucuaccaggagagcgccccggcccagacccagguggcccucguccgcuacgugaaccccgacaccggccgcgugcuguucgaggcgaagcugcacaagcucggguucaugacgaucgccaagaacggcgacucccccaucaccgugcccccgaacggguacuuccgguucgagagcugggucaaccccuucuacacccuggcccccaugggcaccgggaacggccgccggcgcauccaguga

SEQ ID NO: 11226 - RNA, 1647 nt, Artificial Sequence
  derived and/or modified sequence opt1 from VP1__Norovirus_and/or_Norovirus-like__AF414415
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgaggugcaggcggugcuggccggcaacgccuucacggccgggaaggucaucuucgccgcgaucccgcccaacuuccccaucgacaaccucagcgccgcccagaucaccaugugcccccacgugaucguggacguccgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacguguucaccgucagcugccgggugcugacgcgccccucccccgacuucagcuucaacuuccuggugcccccgaccgucgaguccaagaccaagcuguucacccugcccauccugacgaucagcgagauguccaacagccgguuccccgugcccaucgacucccuccacaccagcccgaccgagaacaucgugguccagugccagaacgggcgcgugacccuggacggcgagcugauggggacgacccagcuccugcccucccagaucugcgcguuccggggcacccugacccgcagcacgucccgggccagcgaccaggccgacacccccacgccccgccucuucaaccaccgguggcacauccagcuggacaaccugaacggcaccccguacgaccccgccgaggacauccccgccccgcucgggacccccgacuuccgcggcaagguguucggggucgcgagccagcggaaccccgacuccaccacccgcgcccacgaggccaagguggacaccacgagcgaccgguucacccccaagcugggcucccuggagaucaucaccgagagcggggacuucgacaccaaccaguccacgaaguucaccccggugggcaucggcgucgacaacgaggccgaguuccagcaguggagccuccccaacuacuccgggcaguucacccacaacaugaaccuggcgcccgccguggcccccaacuucccgggcgagcagcuccucuucuuccgcagccagcugcccuccagcgggggccgguccaacgggguccuggacugccucgugccccaggagugggugcagcacuucuaccaggagagcgcccccgcccagacccaggucgcgcuggugcgcuacgugaacccggacacgggccgcguccuguucgaggccaagcuccacaagcugggcuucaugaccaucgccaagaacggggacucccccaucaccgugccgcccaacggcuacuuccgguucgagagcugggugaaccccuucuacacccuggcccccauggggacgggcaacgggcgccggcgcauccaguga

SEQ ID NO: 11227 - RNA, 1647 nt, Artificial Sequence
  derived and/or modified sequence opt1 from VP1__Norovirus_and/or_Norovirus-like__KT779557
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaccgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaucaagcccuucacccuccccauccugacgaucagcgagauguccaacagccgguuccccgugccgaucgacucccugcacaccagccccaccgacaacaucgucgugcagugccagaacgggcgcgugacccucgacggcgagcugauggggacgacccagcugcuccccucccagaucugcgccuuccggggcguccugacccgcagcaccucccgggcgagcgaccaggccgacgccgccacgccccgccuguucaacuaccacuggcacauccagcucgacaaccugaacggcaccccguacgaccccgccgaggacauccccgcgccgcuggggacccccgacuuccggggcaagguguucgggguggccagccagcgcaaccccgacuccaccacgcgggcccacgaggccaaggucgacaccaccagcggccgcuucacccccaagcucgggucccuggagaucagcacggaguccggcgacuucgaccagaaccagccgauccgguucacccccgugggcaucggggucgacaacgaggcggacuuccagcaguggacccugcccgacuacagcggccaguucacccacaacacgaaccucgcccccgccguggccccgaacuuccccggggagcagcugcuguucuuccgcucccagcuccccagcuccggcgggcggagcaacggcauccuggacugccuggugccccaggaguggguccagcacuucuaccaggaguccgccccggcgcagacccagguggcccucgugcgcuacgucaaccccgacaccggccgcgugcuguucgaggccaagcugcacaagcucggguacaugaccaucgccaagagcggcgacucccccaucacggugcccccgaacggguacuuccgguucgagagcugggucaaccccuucuacacccuggcccccaugggcaccgggaacggccgccggcgcauccaguga

SEQ ID NO: 11228 - RNA, 1647 nt, Artificial Sequence
  derived and/or modified sequence opt1 from VP1__Norovirus_and/or_Norovirus-like__AY247432
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaacgggaacuucgucgugcagugccagaacggccgcgugacccucgacggggagcugaugggcacgacccagcugcuccccucccagaucugcgccuuccggggcguccugacccgccaggugagccgggccggggaccagaucgacaccgcgacgccccgcuccuucggcaaccacuggcacauccagcuggacaaccucaacgggaccccguacgaccccgccgaggacauccccggcccgcuggggacccccgacuuccagggcaucguguucggcgucgccagccagcggaacagcgacgggaccacgcgcgcccacgaggccaagguggacacccggaccggccgcuucacccccaagcuggggucccucgucaucagcacggacuccgaggacuuccagcagaacaagcccacccgguucaccccggugggcgugggggucgacagcgaggaggaguucgaccaguggucccugcccgacuacagcggccccaucacccacaacaugaaccuggcgcccgccguggccccgaacuuccccggcgagcagcuccuguucuuccgcucccagcugcccagcuccgggggcaucagcaaggggauccucgacugccuggugccccaggaguggguccagcacuucuaccaggaguccgccccggcgcagacccagguggcccuggugcgguacgucaaccccgacacgggccgcguccucuucgaggccaagcugcacaagcugggguucaugaccaucgccaaggacggcgacagccccaucaccgugcccccgaacggcuacuuccgcuucgaguccugggugaaccccuucuacacgcucgcccccauggggaccggcaacgggcggcgccggauccaguga

SEQ ID NO: 11229 - RNA, 1647 nt, Artificial Sequence
  derived and/or modified sequence opt1 from VP1__Norovirus_and/or_Norovirus-like__AF414411
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccucgagaucaaccccuaccuggcccaccuggcccggauguacaacggguacgccggcguguucgaggugcaggucgugcucgcggggaacgccuucacggccggcaaggugaucuucgccgccaucccgcccaacuuccccaucgacaaccugagcgcggcccagaucaccaugugcccccacgucaucguggacgugcgccagcuggagccgaucaaccuccccaugcccgacguccggaacaacuucuuccacuacaaccagggguccgacagccgccugcggcugaucgccaugcucuacacgccccugcgcgccaacaacuccggcgacgacguguucaccgugagcugccggguccugacccgcccgucccccgacuucagcuucaacuuccucgugccgcccaccguggaguccaagaccaagcuguucacccugcccauccucacgaucagcgagauguccaacagccgguuccccguccccaucgacucccugcacaccagccccaccaagaacaucguggugcagugccagaacggccgcgucacccuggacggggagcucaugggcacgacccagcugcugccgucccagaucugcgccuuccgggggacccucacccgcagcacgucccgggcgagcgaccaggccgacacccccacgccccgccuguucggccaccgguggcacauccagcuggacaaccucaacggcacccccuacgacccggccgaggacauccccgcgccccuggggaccccggacuuccgcggcaagguguucgggguggccagccagcggaaccccgacuccaccacccgcgcccacgaggccaaggucgacaccacgagcggccgguucacccccaagcuggggucccucgagaucaucaccgagagcgacgacuucgacaccaaccaguccacgaaguucacccccgugggcaucggcgucgacaacgaggccgaguuccagcaguggagccugccgaacuacuccgggcaguucacccacaacaugaaccuggcccccgcgguggcccccaacuuccccggcgagcagcuccuguucuuccgcagccagcugccguccagcgggggccgguccaacggggugcucgacugccuggucccccaggagugggugcagcacuucuaccaggagagcgcccccgcccagacccagguggcccugguccgcuacgugaaccccgacacgggccgcguccucuucgaggcgaagcugcacaagcugggcuucaugaccaucgccaagaacggggacuccccgaucaccgugccgcccaacggcuacuuccgguucgagagcugggugaaccccuucuacacccucgcccccauggggacgggcaacgggcgccggcgcauccaguga

SEQ ID NO: 11230 - RNA, 1647 nt, Artificial Sequence
  derived and/or modified sequence opt1 from VP1__Norovirus_and/or_Norovirus-like__AJ277617
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgcccaggccccgggcggggaguucaccgugagcccccgcaacucccccggcgaggugcugcucaaccuggagcugggccccgagaucaacccguaccucgcccaccuggcccggauguacaacggguacgcgggcggguucgagguccagguggugcuggccggcaacgccuucacggccgggaaggucaucuucgccgcgaucccgcccaacuuccccaucgacaaccucagcgccgcccagaucaccaugugcccccacgugaucguggacguccgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgagguguucaccgucagcugccgggugcugacgcgccccucccccgacuucagcuucaacuuccuggugcccccgaccgucgaguccaagaccaagcuguucacccugcccauccugacgaucagcgagauguccaacagccgguuccccgugcccaucgacucccuccacaccagcccgaccgagaacaucgugguccagugccagaacgggcgcgugacccuggacggcgagcugauggggacgacccagcuccugcccucccagaucugcgcguuccggggcacccugacccgcagcacgucccgggccagcgaccaggccgacacccccacgccccgccucuucaaccaccgguggcacauccagcuggacaaccugaacggcaccccguacgaccccgccgaggacauccccgccccgcucgggacccccgacuuccgcggcaagguguucggggucgcgagccagcggaaccccgacuccaccacccgcgcccacgaggccaaggccgacaccacgagcggccgguucacccccaagcuggggucccuggagaucaucaccgagagcgacgacuucgacaccaaccaguccacgaaguucaccccggugggcaucggcguggacaacgaggcggaguuccagcaguggagccuccccaacuacuccgggcaguucacccacaacaugaaccuggcccccgccgucgcccccaacuucccgggcgagcagcuccucuucuuccgcagccagcugcccuccagcgggggccgguccaacggggugcuggacugccucaucccccaggaguggguccagcacuucuaccaggagagcgcccccgcgcagacccagguggcccuggugcgcuacgucaacccggacacgggccgcgugcuguucgaggccaagcuccacaagcugggcuucaugaccaucgccaagaacggggacucccccaucaccgugccgcccaacggcuaccugcgguucgagagcugggucaaccccuucuacacccucgcccccauggggacgggcaacgggcgccggcgcauccaguga

SEQ ID NO: 11231 - RNA, 1647 nt, Artificial Sequence
  derived and/or modified sequence opt1 from VP1__Norovirus_and/or_Norovirus-like__LC036561
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgaguucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacgagcgggcgcuucacccccaagcucggcucccuggagaucagcaccgaguccggcgacuucgaccagaaccagccgacccgguucacgcccguggggaucggcgucgaccacgaggccgacuuccagcaguggagccugcccgacuacuccgggcaguucacccacaacaugaaccucgcccccgccguggcgccgaacuuccccggcgagcagcugcuguucuuccgcagccagcuccccuccagcgggggccgguccaacggcauccuggacugccuggugccccaggaguggguccagcacuucuaccaggagagcgccccggcccagacccagguggcccucgugcgcuacgucaaccccgacaccgggcgcgugcuguucgaggccaagcugcacaagcucggcuucaugacgaucgcgaagaacggggacucccccaucaccgugcccccgaacggcuacuuccgguucgagagcugggucaaccccuucuacacccuggcccccauggggaccggcaacggccgccggcgcgugcaguga

SEQ ID NO: 11232 - RNA, 1647 nt, Artificial Sequence
  derived and/or modified sequence opt1 from VP1__Norovirus_and/or_Norovirus-like__KT732274
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccagguggugcuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgaguucagcuucaacuuccuggugcccccgaccguggaguccaagaccaagcuguucacgcugcccauccugaccaucagcgagauguccaacagccgguuccccguccccaucgacucccuccacaccagcccgaccgagaacaucguggugcagugccagaacgggcgcgucacgcuggacggcgagcugauggggaccacccagcuccugcccucccagaucugcgccuuccggggcgugcugacccgcagcacgucccgggccagcgaccaggcggacaccgccacgccccgccucuucaacuacuacuggcacauccagcuggacaaccugaacggcacccccuacgacccggccgaggacauccccgggccccucggcaccccggacuuccgggggaagguguucggcgucgccagccagcgcaaccccgacuccaccacccgggcccacgaggcgaagguggacaccacgagcgggcgcuucacccccaagcugggcucccuggagaucagcaccgaguccggcgacuucgaccagaaccagcccacccgguucacgccggucgggaucggcguggacagcgaggccgacuuccagcaguggucccuccccgacuacagcgggcaguucacccacaacaugaaccuggcccccgccguggcgcccaacuucccgggcgagcagcuccucuucuuccgcucccagcugcccagcuccgggggccggagcaacggcauccuggacugccucgucccccaggagugggugcagcacuucuaccaggaguccgcccccgcccagacccagguggcccugguccgcuacgugaacccggacaccgggcgcgugcuguucgaggccaagcuccacaagcugggcuucaugacgaucgcgaagaacggggacagccccaucaccgucccgcccaacggcuacuuccgguucgaguccugggugaaccccuucuacacccuggcccccauggggaccggcaacggccgccggcgcgugcaguga

SEQ ID NO: 11233 - RNA, 1647 nt, Artificial Sequence
  derived and/or modified sequence opt1 from VP1__Norovirus_and/or_Norovirus-like__AY247439
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaacaacaacuucgucgugcagugccagaacgggcgcgugacccucgacggcgagcugauggggaccacgcagcugcuccccucccagaucugcgccuuccggggcguccuggcgcgccagaucaaccgggccggcgaccagaucgacaccaccacgccccgcagcuucgaccaccacuggcacauccagcuggacaaccucaacgggaccccguacgaccccgccgaggacauccccggcccgcuggggacccccggcuucaaggggaucguguucggcguggccucccagcggaacagcgacggcaccacccgcgcccacgaggcgaaggucgacacgcggaccgggcgcuucacccccaagcugggcagccucgugaucuccaccgacagcgaggacucccagcagaacaagcccacgcgguucaccccggucggggugggcguggacaacgaggaggaguucgaccaguggagccugcccaacuacuccgggcccaucacccacaacaugaaccuggcccccgccgucgccccgaacuuccccggcgagcagcuccuguucuuccgcagccagcugcccuccagcggcgggaccuccaagggcauccucgacugccuggugccccaggagugggugcagcacuucuaccaggagagcgcgccggcccagacgcaggucgcccuggugcgguacgugaaccccgacaccgggcgcguccucuucgaggccaagcugcacaagcugggcuucaugaccaucgccaaggacggggacucccccaucaccgugcccccgaacggcuacuuccgcuucgagagcugggugaaccccuucuacacgcucgcgcccaugggcaccgggaacggccggcgccggauccaguga

SEQ ID NO: 11234 - RNA, 1647 nt, Artificial Sequence
  derived and/or modified sequence opt1 from VP1__Norovirus_and/or_Norovirus-like__AF539439
augaagauggccagcuccgacgccacccccagcaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagcugcuccugaaccuggagcucggccccgagaucaacccguaccuggcccaccuggcccggauguacaacggguacgccggcggguucgagguccagguggugcucgccggcaacgcguucaccgccgggaagaucaucuucgccgccaucccgcccaacuuccccaucgacaaccuguccgccgcgcagaucaccaugugcccccacgucaucguggacgugcgccagcuggagcccgucaaccuccccaugcccgacgugcggaacaacuucuuccacuacaaccagggcagcgacucccgccugcggcugaucgccaugcucuacaccccgcugcgcgccaacaacagcggcgacgacguguucacggucuccugccgggugcugacccgccccagccccgacuucuccuucaacuuccucgugcccccgaccgucgagagcaagaccaagcccuucacgcugcccauccugaccaucuccgagaugagcaacucccgguuccccgugccgaucgacagccuccacaccucccccaccgagaacaucgugguccagugccagaacgggcgcgugacgcuggacggcgagcugauggggaccacccagcuccugcccagccagaucugcgccuuccggggcgugcugacccgcuccacgagccgggccagcgaccaggcggacacccccaccccgcgccucuucaacuacuacuggcacauccagcuggacaaccugaacggcacccccuacgaccccgccgaggacaucccggggccccucggcacgcccgacuuccgggggaaggucuucggcguggccucccagcgcaaccccgacagcaccacccgggcccacgaggccaagguggacaccacggcggggcgcuucaccccgaagcugggcucccuggagaucagcaccgaguccggcgacuucgaccagaaccagcccacccgguucacgcccgucgggaucggcguggaccacgaggccgacuuccagcaguggagccuccccgacuacuccgggcaguucacccacaacaugaaccuggccccggccgucgcgcccaacuuccccggcgagcagcuccuguucuuccgcagccagcugcccuccagcgggggccgguccaacggcauccuggacugccucgugccgcaggagugggugcagcacuucuaccaggagagcgcccccgcccagacccaggucgcccuggugcgcuacgugaaccccgacaccgggcgcguccuguucgaggccaagcuccacaagcugggcuucaugacgaucgcgaagaacggggacucccccaucaccgugccgcccaacggcuacuuccgguucgagagcugggugaaccccuucuacacccuggcccccauggggaccggcaacggccgccggcgcauccaguga

SEQ ID NO: 11235 - RNA, 1647 nt, Artificial Sequence
  derived and/or modified sequence opt1 from VP1__Norovirus_and/or_Norovirus-like__AF414413
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacggggucuucaccgugagcugccgggugcugacgcgccccucccccgacuucagcuucaacuuccuggugcccccgaccguggaguccaagacccggcuguucacccugcccauccugacgaucagcgagauguccaacagccgcuuccccgugcccaucgacucccuccacaccagcccgaccgagaacaucgucgugcagugccagaacggccgggugacccuggacggggagcugaugggcacgacccagcuccugcccucccagaucugcgccuuccgcggcacccugacccggagcacgucccgcgcgagcgaccaggccgacacccccaucccccgccucuucaaccaccgguggcacauccagcuggacaaccugaacgggaccccguacgaccccgccgaggacauccccgccccgcucggcacccccgacuuccgggggaaggucuucggcguggccagccagcgcaaccccgacuccacgacccgggcgcacgaggccaagguggacgccacccccgggcgcuucaccccgaagcugggcagccuggagaucaucacggaguccgacgacuucgacaccaaccagagcaccaaguucacccccgucggcaucgggguggacaacgaggccgaguuccagcaguggucccuccccaacuacagcggccaguucacgcacaacaugaaccuggcgcccgccgucgccccgaacuuccccggggagcagcuccucuucuuccggucccagcugcccagcuccggcgggcgcagcaacggcgugcuggacugccucgugccccaggaguggguccagcacuucuaccaggaguccgccccggcccagacccagguggcgcuggugcgcuacgucaaccccgacaccggccgggugcuguucgaggccaagcuccacaagcugggguucaugaccaucgccaagaacggcgacagccccaucacggugcccccgaacggguacuuccgcuucgaguccugggucaaccccuucuacacccuggcccccaugggcaccgggaacggccggcgccggauccaguga

SEQ ID NO: 11236 - RNA, 1647 nt, Artificial Sequence
  derived and/or modified sequence opt1 from VP1__Norovirus_and/or_Norovirus-like__AF427112
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacacccgccccaccgagaacaucgucgugcagugccagaacgggcgggugacgcucgacggcgagcugauggggaccacccagcugcuccccagccagaucugcgccuuccgcggcguccugacccgguccacgagccgcgccuccgaccaggcggacaccgccacgccccggcuguucaacuacuacuggcacauccagcucgacaaccugaacggcaccccgugcgaccccgccgaggacauccccgggccgcugggcacccccgacuuccgcgggaagguguucggcguggccagccagcggaaccccgacagcaccaccggggcccacgaggcgaaggucgacaccacggccggccgcuucacccccaagcucggcucccuggagaucagcaccgaguccggggacuucgaccagaaccagccgaccaaguucacgcccgugggcaucggggucgaccacgaggccgacuuccagcaguggagccugcccgacuacuccggccaguucacccacaacaugaaccucgcccccgcgguggccccgaacuuccccggggagcagcugcuguucuuccggagccagcuccccuccagcggcggccgcuccaacgggauccuggacugccuggugccccaggaguggguccagcacuucuaccaggagagcgccccggcccagacccagguggcccucgugcgguacgucaaccccgacaccggccgcgugcuguucgaggcgaagcugcacaagcucggguucaugacgaucgccaagaacggcgacucccccaucaccgugcccccgaacggguacuuccgcuucgagagcugggucaaccccuucuacacccuggcccccaugggcaccggcaacgggcggcgccggauccaguga

SEQ ID NO: 11237 - RNA, 1647 nt, Artificial Sequence
  derived and/or modified sequence opt1 from VP1__Norovirus_and/or_Norovirus-like__AF190817
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacccgcccggcgagguccugcucaaccuggagcugggccccgagaucaaccccuaccucgcccaccuggcccggauguacaacggguacgccggcggguucgagguccagguggugcuggccggcaacgcguucaccgccgggaagaucaucuucgccgccaucccgcccaacuuccccaucgacaaccucuccgccgcgcagaucaccaugugcccccacgugaucguggacguccgccagcuggagcccgugaaccugcccaugccggacgugcggaacaacuucuuccacuacaaccagggcagcgacucccgccuccggcugaucgccaugcuguacacgccccuccgcgccaacaacagcggcgacgacgucuucaccguguccugccgggugcugacccgccccagccccgacuucuccuucaacuuccuggucccgcccaccguggagagcaagaccaagcccuucacgcuccccauccugaccaucuccgagaugagcaacucccgguucccggugcccaucgagagccugcacaccgggcccaccgagaacaucgucgugcagugccagaacggccgcgugacgcucgacggggagcugaugggcaccacccagcugcuccccucccagaucugcgccuuccggggcguccugacccgcagcacgucccgggccagcgaccaggcggacaccgccaccccgcgccuguucaacuacuacuggcacgugcagcucgacaaccugaacgggacccccuacgaccccgccgaggacaucccgggcccccuggggacgcccgacuuccggggcaagguguucggggucgccucccagcgcaaccccgacagcaccacccgggcccacgaggcgaagguggacaccacggccggccgcuucaccccgaagcucggcagccuggagaucuccaccgacagcuccgacuucgaccagaaccagcccacccgguucacgcccgucgggaucggcguggacaacgaggccgacuuccagcaguggagccugcccgacuacuccgggcaguucacccacaacaugaaccucgccccggcgguggcccccaacuuccccggcgagcagcugcuguucuuccgcagccagcuccccuccagcgggggccgguccaacggcguccuggacugccuggugccgcaggagugggcccagcacuucuaccaggagagcgcccccgcccagacccagguggcgcucguccgcuacgugaaccccgacaccgggcgcgugcuguucgaggccaagcugcacaagcucggcuucaugacgaucgccaagaacggggacucccccaucaccgucccgcccaacggcuacuuccgguucgagagcugggugaaccccuucuacacccuggcccccauggggaccggcaacggccgccggcgcauccaguga

SEQ ID NO: 11238 - RNA, 1647 nt, Artificial Sequence
  derived and/or modified sequence opt1 from VP1__Norovirus_and/or_Norovirus-like__LC035072
augaagauggccagcaacgacgccacccccuccaacgacggcgcggccgggcuggugccggagaucaacaacgaggccauggcccucgaccccgucgccggcgcggccaucgccgcgccccugaccgggcagcagaacgugaucgaccccuggaucaugaacaacuucgugcaggccccgggcggggaguucacggucagcccccgcaacucccccggcgaggugcugcucaaccuggagcugggccccgagaucaacccguaccucgcccaccuggcccggauguacaacggguacgccggcggguucgaggugcaggucgugcuggccggcaacgcguucaccgccgggaagaucaucuucgccgccaucccgcccaacuuccccaucgacaaccucagcgccgcgcagaucaccaugugcccccacgugaucgucgacgugcgccagcuggagcccgugaaccugcccaugcccgacguccggaacaacuucuuccacuacaaccagggcuccgacagccgccuccggcugaucgccaugcuguacaccccgcuccgcgccaacaacuccggcgacgacguguucacggugagcugccggguccugacccgccccucccccgaguucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccgggccagcgaccaggcggacaccgccacgccccgccuguucaacuacuacuggcacauccagcucgacaacccgaacggcacccccuacgaccccgccgaggacaucccggggccccugggcacccccgacuuccgggggaagguguucggcgucgccagccagcgcaaccccgacuccaccacccgggcccacgaggcgaagguggacaccacgagcgggcgcuucaccccgaagcugggcucccucgagaucagcaccgaguccgacgacuucgaccagaaccagcccacccgguucacgcccgucggcaucgggguggaccgcgaggccgacuuccagcaguggagccugcccgacuacuccggccaguucacccacaacaugaaccuggccccggccguggcggccaacagccccggggagcagcucaucuucuucuggucccagagccccuacugcggcgggcgguccaaccgcguccuggacugcauggugccccaggagugggugcagcacuucuaccaggagagcgccccggcccagacccagcuggcccucguccgcuacgugaaccccgacaccggccgggugcuguucgaggcgaagcugcacaagcucggcuucaugacgaucgccaagaacggggacucccccaucaccgugcccccgaacggcuacuuccgcuucgagagcugggucaaccccuucuacacccuggcccccauggggaccggcaacgggcggcgccgggugcaguga

SEQ ID NO: 11239 - RNA, 1647 nt, Artificial Sequence
  derived and/or modified sequence opt1 from VP1__Norovirus_and/or_Norovirus-like__DQ093064
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacgccgaccccaacgaguccaucguggugcagccccagaacggccgcugcacccuggacggcacccuccaggggacgacccagcugguccccacccagaucugcgccuuccggggcacccugaucagccagacggcgcgcgccaccgacuccaccgacagcccgcagcgggcccgcgaccacccccuccacgugcaggucaagaaccuggacgggacccaguacgaccccacggacgacaucccggccgugcugggcgccaucgacuucaagggcaccguguucggggucgcgucccagcgggacgugagcggcccccaggagcaggggcacuacgccacccgcgcccacgaggcccacaucgacaccacggaccccaaguacgcgcccaagcucggcaccauccugaucaaguccgagagcaacgacuucaucaccaaccagccgauccgguucacccccguggggaugggcgacaacaacuggcgccagugggagcugcccgacuacagcggccggcucacgcugaacaugaaccuggcccccgccgucuccccgagcuuccccggggagcgcauccucuucuuccgcuccaucgugcccagcgccggcggguacggcuccggguacaucgacugccugaucccccaggaguggggccagcacuucuaccaggaggccgcgccgagccaguccgccguggcccugguccgguacgugaaccccgacaccggccgcaacaucuucgaggccaagcuccaccgggagggguuccugaccguggccaacagcggcaacaaccccaucgucgugcccccgaacggguacuuccgcuucgaggcgugggugaaccaguucuacacccuggcccccaugggcuccgggcagggccggcgccgguga

SEQ ID NO: 11240 - RNA, 1647 nt, Artificial Sequence
  derived and/or modified sequence opt1 from VP1__Norovirus_and/or_Norovirus-like__L23830
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccagguggugcuggcgggcaacgccuucacggccgccaaggugaucuucgccgcgaucccgcccaacuuccccaucgacaaccucagcgccgcccagaucaccaugugcccccacgugaucgucgacgugcgccagcuggagcccaucaaccugcccaugcccgacgugcggaacaacuucuuccacuacaaccagggguccgacagccgccuccggcugaucgccaugcuguacaccccgcuccgcgccaacaacuccggcgacgacgucuucaccgugagcugccgggugcugacgcgccccucccccgacuucagcuucaacuuccugguccccuccaccauggagagcaagaccaagccguucacccuccccauccugacgaucuccgagaugagcaacucccgguuccccgugcccaucgacagccugcacaccuccccgaccgagagcaucgugguccagugccagaacggccgcgugacccucgacggggagcugaugggcacgacccagcugcuccccaaccagaucugcgcguuccgggggacccugacccgcuccacgaaccgggccagcgaccaggccgacaccgccacgccccgccuguucaaccaccacuggcacauccagcucgacaaccugaacggcacccccuacgacccggccgaggacauccccgcgccccugggcaccccggacuuccgggggaagguguucggcgucgccgggcagcgcaaccccgacagcaccacccgggcccacgaggccaagguggacaccacguccggccgcuucacccccaagcucgggagccuggagaucaccaccgaguccgacgacuucgaccccaaccagagcacgaaguucaccccggugggcaucggcgucgacaacgaggcggacuuccagcaguggucccugcccgacuacagcgggcaguucacccacaacaugaaccucgcccccgccguggcccccaacuucccgggcgagcagcugcuguucuuccggucccagcuccccagcuccgggggccgcagcaacgggauccuggacugccuggucccccaggagugggugcagcacuucuaccaggaguccgcccccgcgcagacccagguggcccucguccgguacgugaacccggacacgggccgcgugcuguucgaggccaagcugcacaagcucggcuucaugaccaucgccaagaacggggacagccccaucaccgucccgcccaacggcuacuuccgcuucgaguccugggugaaccccuucuacacccuggcccccauggggacgggcaacgggcggcgccggauccaguga

SEQ ID NO: 11241 - RNA, 1647 nt, Artificial Sequence
  derived and/or modified sequence opt1 from VP1__Norovirus_and/or_Norovirus-like__KX907728
augaagauggccagcaacgacgcgcccccguccagcgacggcgccgggaaccuggugcccgagucccaccaggagguccucccccuggcccccguggccggcgccgagcuggccgcgccgguggucgggcagaccaacaucaucgaccccuggaucaaggagaacuucgugcaggcgccccagggcgaguucaccgugagccccaagaacgccccgggggagauccucgucaaccuggagcugggccccaaccucaaccccuaccuggagcaccugucccgcauguacaacgccuacgccggcgggaucgagguggagaucauccucgccggcaacgccuucacggccgggaagauccugaucgccgcggugcccccgaacuuccccgucgagagcguguccgccagccaggccacccaguucccccacgccaucguggacguccggacccuggagcccgugcgccucccgcugcccgacgugcgguccaacuucuuccacuacaccacgaaggacgagcccaagaugcgccuggucaucuggcucuacacgccccugcggaccaacggcagcggggacgacuccuucaccgugagcggccgccugcucacccggccguccauggacuuccaguucagcuuccuggugccgcccaccgucgagaccaagaccgugcuguucacggugcccggccucacgccccaggagauguccaacagccgcuggcccgcccagaucuccgggauggucgugcggggcaacgagccccaggugguccaguuccagaacgggcgcugccacaccgacggcacccugcugggcaccaccaccgugagcgagcagugcaucgcgggguucgucggcaccuccacgaacacccggagcgccaccgggagcaccacggagacccgcaccggcgacaccgaccucuggcugcggcuggaggagcccaacgggcagccguacgacaucuucggcgaccagcccgcgccccucggcacgccggacuuccgcgccgugaucgugggguucgccucccggccccagacccagggcagcuacaugaacgaggccuacgucaacaccguggacucccacuucgcccccgccaccgggaacacgaagaucauccugcgccggggcgggaccggccacgugggcgggggccaccuguggaaguuccgccccuucggggucgagggcggggagggccgggugagcuaccaggaguacgugcucccgaacuacuccggcgccaccgccagcaaccacaaccuggcgccgcccgucgcgccccgcaugcccggggagcugcuccugcuguucgaguccgacaugcccgugugggacgacggccacggggccgcccccgcccagaagauccacugccuccugccccagcaguucaucacccacuucuucgacagccaggccccggcccuggccgaggccgcgcuccugcgguacgugcaccccgacuccagccgcguccuguucgagacgaagcucuaccgcgagggcuucauggugguguccgcccccaccggccgguucgacuucccccuggacggguacuuccgcuucgacagcugggucaacuccuucuacgugcugagcccggugggcuccgggcagggccggcgcuga

SEQ ID NO: 11242 - RNA, 1644 nt, Artificial Sequence
  derived and/or modified sequence opt1 from VP1__Norovirus_and/or_Norovirus-like__AB039779
augaagauggccagcaacgacgccgcgcccuccaacgacggcgccgccaaccuggugcccgaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagacgccccgcuccgccgacagcaccgacuccgcgccccgggugcgcaaccacccgcuccacguccagcugaagaaccuggacgggacccccuacgaccccaccgacgaggugcccgccgugcucggcgcgaucgacuucaagggcaccgucuucgggguggccagccagcggaacaccacgggcuccagcgugggggccacccgcgcccacgagguccacaucgacaccaccaacccgcgguacacgcccaagcugggcagcgugcugauguacuccgagagcuccgacuucgacgacgggcagcccacccgcuucacccccaucggcaugggcgccgacgacuggcaccagugggagcucccggaguacagcgggcaccugacccugaacaugaaccucgcgcccgccguggcccccgccuuccccggcgagcggauccuguucuuccgcuccgucgugccgagcgccgggggcuacggguccggccagaucgacugccugaucccccaggagugggugcagcacuucuaccaggaggccgcccccagccaguccgccgucgcccucauccgcuacgugaaccccgacacgggccggaacaucuucgaggcgaagcugcaccgcgagggguucaucaccguggccaacagcggcaacaacccgaucgucgugccgcccaacggguacuuccgguucgaggccugggugaaccaguucuacgcccugacccccaugggcaccgggcagggccgccggcgcguccaguga

SEQ ID NO: 11243 - RNA, 1644 nt, Artificial Sequence
  derived and/or modified sequence opt1 from VP1__Norovirus_and/or_Norovirus-like__AB039778
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgcgaucgacuucaagggcaccgucuucgggguggccucccagcggaacaccacgggcagcagcgugggggccacccgcgcccacgagguccacaucgacaccaccaacccccgguacacgccgaagcugggcuccgugcugauguacagcgaguccagcgacuucgacgacgggcagcccacccgcuucacccccaucggcaugggcgccgacgacuggcaccagugggagcuccccgaguacuccgggcaccugacccugaacaugaaccucgcgccggccguggcccccgccuuccccggcgagcggauccuguucuuccgcagcgucgugcccuccgccgggggcuacgggagcggccagaucgacugccugaucccgcaggagugggugcagcacuucuaccaggaggccgcccccucccagagcgccgucgcccucauccgcuacgugaaccccgacacgggccggaacaucuucgaggcgaagcugcaccgcgagggguucaucaccguggccaacuccggcaacaaccccaucgucgugccgcccaacggguacuuccgguucgaggccugggugaaccaguucuacacccugacccccaugggcacggggcagggccgccggcgcguccaguga

SEQ ID NO: 11244 - RNA, 1644 nt, Artificial Sequence
  derived and/or modified sequence opt1 from VP1__Norovirus_and/or_Norovirus-like__KY424345
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggcgaucgacuucaagggcgccguguucggggucgccagccagcgcgacguguccggcacccaggugggggccacccgggcccacgagguccacaucaacaccacggacccccgcuacacccccaagcugggcagcauccugaugcacagcgaguccgacgacuucgugaccggccagccgauccaguucacccccguggggaugggcgacaacgacuggcaccagugggagcuccccgacuacagcgggcaccugacgcugaacaugaaccucgcgcccgccgucgccccggccuuccccggcgagcggauccuguucuuccgcuccaucgugcccagcgccgggggcuacggcuccgggcagaucgacugccugaucccccaggagugggugcagcacuucuaccaggaggccgccccgagccaguccgccgucgcccucauccgcuacgugaaccccgacaccggccggaacaucuucgaggcgaagcugcaccgcgagggguucaucaccguggccaacagcggcaacaaccccaucgucgugcccccgaacggguacuuccgguucgaggccugggugaaccaguucuacacccugacgcccaugggcaccggccaggggcgccggcgcaaccaguga

SEQ ID NO: 11245 - RNA, 1644 nt, Artificial Sequence
  derived and/or modified sequence opt1 from VP1__Norovirus_and/or_Norovirus-like__HQ169542
augaugauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccuggugagccagaccucccgcagcgccgacuccaccgacagcgcgccccggguccgcaaccacccccuccacgugcagcugaagaaccuggacgggacgccguacgaccccaccgacgaggugcccgccguccucggcgccaucgacuucaagggcaccguguucgggguggccucccagcggaacaccacgggcgggagcgucggcgccacccgcgcccacgaggugcacaucgacaccaccaacccccgguacacgccgaagcuggggagcgugcugauguacuccgagagcuccgacuucgacgacggccagcccacccgcuucacccccaucggcaugggggccgacgacuggcggcagugggagcuccccgaguacagcggccaccugacccugaacaugaaccucgcgccggccgucgcccccgccuuccccggggagcgcauccuguucuuccgcuccguggugcccagcgcgggcggguacggcuccggccagaucgacugccugaucccgcaggaguggguccagcacuucuaccaggaggccgcccccagccaguccgccguggcccucauccgguacgugaaccccgacacggggcgcaacaucuucgaggcgaagcugcaccgggagggcuucaucaccgucgccaacagcgggaacaaccccaucguggugccgcccaacggcuacuuccgcuucgaggccugggucaaccaguucuacacccugacccccauggggacgggccagggccggcgccgggugcaguga

SEQ ID NO: 11246 - RNA, 1644 nt, Artificial Sequence
  derived and/or modified sequence opt1 from VP1__Norovirus_and/or_Norovirus-like__KX228762
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgccaucgacuucaagggcaccgucuucgggguggccucccagcggaacaccacgggcaacagcaucggggccacccgcgcccacgaggugcacaucgacaccaccaacccccgguacacgccgaagcugggcagcguccugaugcacuccgagagcaacgacuucgacgacgggcagcccacccgcuucacccccaucggcaugggcgcggacgacuggcaccagugggagcuccccgaguacuccgggcaccugacccugaacaugaaccucgccccggccguggcccccgcguuccccggcgagcggauccuguucuuccgcagcgugguccccuccgccgggggcuacgggagcggccacaucgacugccugaucccgcaggagugggugcagcacuucuaccaggaggccgcccccucccagagcgccguggcgcucauccgcuacgucaaccccgacacgggccggaacaucuucgaggccaagcugcaccgcgagggguucaucaccguggccaacuccggcaacaaccccaucguggucccgcccaacggguacuuccgguucgaggccugggugaaccaguucuacacccugacccccaugggcacggggcagggccgccggcgcgugcaguga

SEQ ID NO: 11247 - RNA, 1644 nt, Artificial Sequence
  derived and/or modified sequence opt1 from VP1__Norovirus_and/or_Norovirus-like__AF414410
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagauccugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccgucuuccugccccugcccgacauccgcaaccgguucuuccacuacaaccaggagaacaccccgcgcaugcggcucguggccaugcuguacacgccccugcgcgccaacagcggcgaggacguguucaccgucuccugccgggugcucacccgccccgcgcccgacuucgaguucaccuuccuggugccgcccaccgucgagagcaagaccaagcccuucacgcugcccauccucacccugggggagcuguccaacagccgguucccggcccccaucgacaugcucuacaccgaccccaacgagaccaucguggugcagccccagaacggccgcugcacgcuggacggcacccugcaggggaccacccagcucgucccgacgcagaucugcuccuuccggggcacccugaucagccagaccucccgcagcgccgacuccaccgacagcgcgccccgggcccgcaaccacccccugcacgugcagcucaagaaccuggacgggacgccguacgaccccaccgacgagguccccgccgugcugggcgccaucgacuucaagggcaccguguucggggucgccucccagcggaacaccacgggcagcagcgugggggccacccgcgcccacgaggugcacaucgacaccaccgacccccgguacacgccgaagcucggcuccguccugauguacagcgaguccaacgacuucgacgacgggcagcccacccgcuucacccccaucggcaugggcgcggacgacuggcaccagugggagcugcccgaguacagcgggcaccucacccugaacaugaaccuggccccggccguggcccccgcguuccccggcgagcggauccucuucuuccgcuccgugguccccagcgccgggggcuacggguccggccagaucgacugccugaucccgcaggagugggugcagcacuucuaccaggaggccgcccccagccaguccgccguggcgcugauccgcuacgucaaccccgacacgggccggaacaucuucgaggccaagcuccaccgcgagggguucaucaccguggccaacagcggcaacaaccccaucguggucccgcccaacggguacuuccgguucgaggccugggugaaccaguucuacacccugacccccaugggcacggggcagggccgccggcgcgugcaguga

SEQ ID NO: 11248 - RNA, 1644 nt, Artificial Sequence
  derived and/or modified sequence opt1 from VP1__Norovirus_and/or_Norovirus-like__KU935739
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggcccgcaaccacccccuccacgugcagcugaagaaccuggacgggacgccguacgaccccaccgacgagguccccgccgugcucggcgccaucgacuucaagggcaccguguucggggucgccucccagcggaacaccacgggcaacagcaucggggccacccgcgcgcacgaggugcacaucgacaccaccaacccccgguacacgccgaagcugggcagcgugcugauguacuccgagagcaacgacuucgacgacgggcagcccacccgcuucacccccaucggcaugggcgccgacgacuggcaccagugggagcuccccgaguacuccgggcaccugacccugaacaugaaccucgccccggccgucgcgcccgccuuccccggcgagcggauccuguucuuccgcagcguggugcccuccgccgggggcuacgggagcggccacaucgacugccugaucccgcaggaguggguccagcacuucuaccaggaggccgcccccucccagagcgcgguggcccucauccgcuacgugaaccccgacacgggccggaacaucuucgaggccaagcugcaccgcgagggguucaucaccgucgccaacuccggcaacaaccccaucguggugccgcccaacggguacuuccgguucgaggccugggucaaccaguucuacacccugacccccaugggcacggggcagggccgccggcgcgugcaguga

SEQ ID NO: 11249 - RNA, 1644 nt, Artificial Sequence
  derived and/or modified sequence opt1 from VP1__Norovirus_and/or_Norovirus-like__KX268709
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggcccgcaaccacccccuccacgugcagcugaagaaccuggacgggacgccguacgaccccaccgacgagguccccgccgugcucggcgccaucgacuucaagggcaccguguucggggucgccucccagcggaacaccacgggcaacagcaucggggccacccgcgcgcacgaggugcacaucgacaccaccaacccccgguacacgccgaagcugggcagcgugcugaugcacuccgagagcaccgacuucgacgacgggcagcccacccgcuucacccccaucggcaugggcgccgacgacuggcaccagugggagcuccccgaguacuccgggcaccugacgcugaacaugaaccucgccccggccgucgcgcccgccuuccccggcgagcggauccuguucuuccgcagcguggugcccuccgccgggggcuacgggagcggccacaucgacugccugaucccgcaggaguggguccagcacuucuaccaggaggccgcccccucccagagcgcgguggcccucauccgcuacgugaaccccgacaccggccggaacaucuucgaggccaagcugcaccgcgagggguucaucaccgucgccaacuccggcaacaaccccaucguggugccgcccaacggguacuuccgguucgaggccugggucaaccaguucuacacccugacgcccaugggcaccgggcagggccgccggcgcgugcaguga

SEQ ID NO: 11250 - RNA, 1644 nt, Artificial Sequence
  derived and/or modified sequence opt1 from VP1__Norovirus_and/or_Norovirus-like__KX158282
augaagauggccagcaacgacgccgcgcccuccaacgacggcgccgccaaccuggugccggaggccaccaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucacggccgggaagaucaucuucgccgcggugccgccccacuuccccguggagaacaucuccgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagacgaagcccuucacccuccccauccugacccugggggagcucuccaacagccgguucccggcccccaucgacaugcuguacaccgaccccaacgaggccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgccaucgacuucaagggcaccguccuggggguggccucccagcggaacaccacgggcagcagcaucggggccacccgcgcccacgaggugcacaucgacaccaccaacccccgguacacgccgaagcugggcuccguccucaugcacagcgaguccaccgacuucgacgacgggcagcccacccgcuucacccccaucggcaugggcgcggacgacuggcaccagugggagcugcccgaguacagcgggcaccugacgcucaacaugaaccuggccccggccguggcccccgcguuccccggcgagcggauccuguucuuccgcuccgugguccccagcgccgggggcuacggguccggccacaucgacugccucaucccgcaggagugggugcagcacuucuaccaggaggccgcccccagccaguccgccguggcgcugauccgcuacgucaaccccgacaccggccggaacaucuucgaggccaagcugcaccgcgagggguucaucaccguggccaacagcggcaacaaccccaucguggucccgcccaacggguacuuccgguucgaggccugggugaaccaguucuacacccucacgcccaugggcaucgggcagggccgccggcgcgugcaguga

SEQ ID NO: 11251 - RNA, 1644 nt, Artificial Sequence
  derived and/or modified sequence opt1 from VP1__Norovirus_and/or_Norovirus-like__AB126320
augaagauggccagcuccgacgccgcgcccagcaccgacggcuccgcccgccuggugccggaggucaacaacgagaccauggcccucgagcccguggugggggcgccccuggccgcccccgucgccggccagcacaacaucaucgacccguggaucaagaugaacuucgugcaggcccccaacggggaguucacggugagcccccggaacgcccccggcgagauccugcucgaccuggagcuggggccggaccucaaccccuaccugucccaccuggcgcgcauguacaacggcuacgccggcgggauggagguccagguggugcucgccggcaacgccuucaccgccgggaagaucaucuucgcggccgucccgcccaacuuccccgccgagaaccugagcgccgcccaggugaccaugugcccccacgugaucgucgacgugcggcagcuggagcccgugaugcuccccaugccggacauccgcaacaagcuguuccacuacaaccaggucgacgaccccaagcugcggcuccuggcguaccuguacacgccccuccgcgccaacaacgccggcgacgacguguucaccguguccugccggguccugacccgccccaccccggacuucgaguucauguuccuggugccgcccaccguggagagcaagacgaagcccuucucccuccccagccugacccuggacgagcucuccaacagccgguuccccgcccccaucguccagcuguacaccaacccccacgacaaccugguggugcagccgcagaacgggcgcugcaccaucgacggccuccugcagggcacgacccagcuggucuccugcaacgugugcagcuuccgggggaccaucggcgacgggcagcccgccucccacagcgaggaggagaucaugcccauggcguucaacauccagcgcgagaucaugcucgagaaccuggacggcaccccguacgaccccgccgacgacauccccgccguccugggcucccccgacuuccagggggugaucuucggcauccucagccagcggaacacggacgggcagacccgcgcccacgaggccaagguggacacccgggcggcccgcuucgccccgaagcugggcuucgucguggccaccguggaguccacggacuuccacgcgaaccagcccagccgguucacccccgucgggcugggcggcgacaacaaccaggacuucaaccaguggcgccuccccgccuacgggggcgcccugaccaacaacaccaaccuggccccgcccgugaugcccguguaccccggggagcagcuccuguucuuccggagccagcugccguccagcggcggggucgugggcggcuggcucgacugccugcugccccaggagugggugcagcacuucuuccaggaguccgccacgagccaguccgacgucgcgcucgugcgcuacaucaaccccaccaccgggcgggugcuguucgaggccaagcugcacaagcagggcuuccucaccgucgccgccagcggguccuacccccugguggugccggccgacggcuacuuccgcuucgagagcugggucaaccaguucuacacgcuggcgcccauggggaacggcuccggccgccggcgcgcccgguga

SEQ ID NO: 11252 - RNA, 1644 nt, Artificial Sequence
  derived and/or modified sequence opt1 from VP1__Norovirus_and/or_Norovirus-like__AY077644
augaagauggccagcaacgacgccucccccagcgcggacggcuccgccgggcuggugccggaggucaacaacgagaccauggcccucgagcccguggugggcgcgccccuggccgcccccgucgccgggcagcacaacaucaucgacccguggaucaagaugaacuucgugcaggcccccaacggcgaguucaccgugagcccccgcaacgcccccggggagauccugcucgaccuggagcugggcccggaccucaaccccuaccugucccaccuggcgcggauguacaacggcuacgccgggggcauggagguccagguggugcucgccgggaacgccuucacggccggcaagaucaucuucgcggccgucccgcccaacuuccccgccgagaaccugagcgccgcccaggugaccaugugcccccacgugaucgucgacgugcgccagcuggagcccgugaugcuccccaugccggacauccggaacaagcuguuccacuacaaccaggucgacgaccccaagcugcgccuccuggcguaccuguacacgccccuccgggccaacaacgccggggacgacguguucaccguguccugccgcguccugacccggcccaccccggacuucgaguucauguuccuggugccgcccaccguggagagcaagaccaagcccuucucccuccccagccugacgcuggacgagcucuccaacagccgcuuccccgcccccaucguccagcuguacaccaacccccacgacaaccugguggugcagccgcagaacggccggugcaccaucgacggccuccugcaggggaccacgcagcuggucuccugcaacgugugcagcuuccgcggcacccucggggacggccagcccgccucccacagcgaggaggagaucaugcccauggcguucaacauccagcgggagaucaugcuggagaaccuggacggcuccccguacgaccccaccgacgacauccccgccguccucgggagccccgacuuccagggcgugguguucgggauccugucccagcgcaacaccgacggccagacgcgggcccacgaggccaaggucgacacccgccuggcccgguucgcgccgaagcucggguucgugguggccaccgucgagaacaccgacuuccacgccaaccagcccugccgcuucacgcccgugggccugggcggggacaacaaccgggacuucaaccaguggggccugcccgccuacgggggcgcgcucaccaacaacaccaaccuggccccgcccgugaugcccgucuaccccggggagcagcuccuguucuuccgcagccagcugccgagcuccggcggcguggucgggggcuggcuggacugccuccugccccaggagugggugcagcacuucuuccaggagagcgccaccucccagagcgacguggcccuggugcgguacaucaaccccacgaccgggcgcguccucuucgaggccaagcugcacaagcagggcuuccugaccguggcggccuccgggagcuacccccugguggucccggccgacggcuacuuccgguucgaguccugggugaaccaguucuacacccucgcccccaugggcaacgggagcggccgccgccgggugcgcuga

SEQ ID NO: 11253 - RNA, 1644 nt, Artificial Sequence
  derived and/or modified sequence opt1 from VP1__Norovirus_and/or_Norovirus-like__AY823306
augaagauggccagcuccgacgccgcgcccagcuccgacggcagcgccgggcuggugccggaggucaacuccgagaccauggcccucgagcccguggugggcgcgccccuggccgcccccgucgccgggcagcacaacaucaucgacccguggaucaagcugaacuucgugcaggcccccaacggcgaguucaccgugagcccccgcaacgcccccggggagauccuccuggaccuggagcucggcccggaccugaaccccuaccuggcgcaccucucccggauguacaacgccuacgccggcgggauggagguccaggugauccuggccggcaacgccuucacggcggggaagaucaucuucgccgccgugccgcccaacuucccccuggagaaccucagcgccgcccagaucaccaugugcccccacaucaucgucgacgugcgccagcuggagcccgugaugcugcccaugccggacguccggaaccgccucuuccacuacaaccaggugcgggagccccgccugcggcugguggcguaccucuacacgccccugcgcgccaacaacgccggcgacgacgucuucaccguguccugccgggugcugacccgccccagccaggacuucgaguucauguuccucgucccgcccuccguggagagcaagaccaagcccuucucccugcccaaccugacccucgccgagcugagcaacucccgguucccgcugcccaucgagcagcucuacaccaacccccuggacaaccuggugguccagccccagaacgggcgcugcacgaucgacggcauccuccugggcaccacccagcuggugccgagccucaucugcuccaugcgggggacccuggaggccgaccaggcgagcggccacacggacgacgaguccgugcagagccgcgccuucaaccggcagcgcagccugaugcucgagaaccccgacggguccgccuucgaccccagcgacgaggucccggccgugcugggcguccccgacuuccggggcgugguguucgggguccugucccagcgcaacaacggcgacaccacccggagccacgaggccaagaucgacacccgccggccccgcuacgcgcccaagcucggguucguggaggugcugacggaguccgacgacuuccagaacggcccgcccaccaaguucacccccgucgggcugggcggcgacgggaaccccgacuuccagcagugggcccucccggacuacggcggggcccugaccaacaacacgaaccuggccccgcccguggugcccgucuaccccggcgagcagauccucuucuuccgcagccagcugcccuccagcgggggcaccguggcgggcuggcuggacugccuccugccccaggaguggauccagcacuucuaccaggacuccgccgccgcccagagcgacguggcccugguccgguacaucaaccccgcgaccgggcgcgugcuguucgaggccaagcuccaccggcagggcuuccugaccguguccgccgccgggccgcaccccgucguggcccccgcggacggcuacuuccgcuucgagagcugggugaaccaguucuacacgcuggcccccauggggaacggcuccggccggcgccgggucuga

SEQ ID NO: 11254 - RNA, 1638 nt, Artificial Sequence
  derived and/or modified sequence opt1 from VP1__Norovirus_and/or_Norovirus-like__KF586508
augaugauggccagcaaggacgccaccuccaacauggacggcaccagcggggcgggccagcuggugcccgagaacaacaacacguccgagccgaucaacauggagcccgucgccggggccgugaccgccgccgcgaccgccggccaggugaacaugaucgaccccuggaucaugaacaacuacguccaggcgccccagggggaguucaccaucagcccgaacaacacgcccggcgacauccucuucgaccugcagcugggcccccaccucaaccccuuccuggcccaccugucccagauguacaacgggugggugggcaacaugaaggugcgcgucgugcucgccgggaacgccuucagcgccggcaagaucaucgugugcugcaucccgcccggguucuccgcccccaacaucagcaucgcccaggcgaccauguucccccacgucaucgccgacgugcgggugcuggagccgaucgacaucccccuggacgacguccgcaacgugcuguuccacaacaacgacaacggcaaccagaccaugcggcugcugugcaugcucuacacgccccugcgcuccggcgggaccagcuccggcaccgaccccuucgugaucgccgggcggguccugaccugcccgacccccgacuucaacuuccucuuccuggugccgcccacgguggagcagaagaccaagcaguucagcguccccaaccugccccucaacgugauguccaacagccgcgugcccucccugcugaacgccauggucgugagccccgaccaggcccaggugguccaguuccagaacggccggugcacccucgacggccagaugcuggggaccacgaccguguccgcgagcugcgucgcccgcuuccggggcaagaccuuccaggccccggacaaccgccuggggaucaaccucgccgagaucuccggcgagcccuaccacgccuucgagagccccgcgccccugggguucccggacuucggcgacggcgacuggcacgugaccgccacgaaggugacccccagccagcuggaggccaacgaccccgucgugauggggaacgugcagccguacaacccccaguucgcgccccaccucggcacccuggucguggagaaccccaccccggacaacgugacgaccgggaccgaccuccucuucaacaucaccuggcuguccaaccgggccaacaaccgcuucaaccccugggucauccccaacuacggcagcacgcugaccgaggccgcccagcucgcccccuccaucuucccgcccggguucggcgagaccaucguguacuucaacagcaccuuccccgccgugggcgcgacgacccacgccgccauccccugccugcugccgcaggaguucgucgcccacuucgugaacgagcaggcccccauccgcggggaggcggcccuccugcacuacaucgaccccgacacccaccggaaccugggcgaguucaagaucuaccccgagggguucgugaccugcgucccgaacgugggcgggacgggcccccagucccuccccaccaacggcaucuucguguucgucagcugggugucccgguacuaccagcugaagcccguggggaccgccggccaggcccgccggcuguga

SEQ ID NO: 11255 - RNA, 1638 nt, Artificial Sequence
  derived and/or modified sequence opt1 from VP1__Norovirus_and/or_Norovirus-like__HQ637267
augaugauggccagcaaggacgccaccuccaacauggacggcaccagcggggcgggccagcuggugcccgagaacaacaacacguccgagccgaucaacauggagcccgucgccggggccgugaccgccgccgcgaccgccggccaggugaacaugaucgaccccuggaucaugaacaacuacguccaggcgccccagggggaguucaccaucagcccgaacaacacgcccggcgacauccucuucgaccugcagcugggcccccaccucaaccccuuccuggcccaccugucccagauguacaacgggugggugggcaacaugaaggugcgcgucgugcucgccgggaacgccuucagcgccggcaagaucaucgugugcugcaucccgcccggguucuccgcccccaacaucagcaucgcccaggcgaccauguucccccacgucaucgccgacgugcgggugcuggagccgaucgacaucccccuggacgacguccgcaacguccucuuccacaccaacgacaacggcaaccagaccaugcggcugcugugcaugcucuacacgccccugcgcuccggcgggaccagcuccggcaccgaccccuucgugaucgccgggcggguccugaccugcccgacgcccgacuucaacuuccucuuccuggugccgcccaccguggagcagaagaccaagcaguucagcguccccaaccugccccucaacgugauguccaacagccgcgugcccucccugcugaacgccauggucgugagccccgaccaggcccaggugguccaguuccagaacggccggugcacccucgacggccagaugcuggggacgaccaccguguccgcgagcugcgucgcccgcuuccggggcaagaccuuccaggccccggacaaccgccuggggaucaaccucgccgagaucuccggcgagcccuaccacgccuucgagagccccgcgccccugggguucccggacuucggcgacggcgacuggcacgugacggccaccaaggugacccccagccagcuggaggccaacgaccccgucgugguggggaacguccagccguacaacccccaguucgcgccccaccucggcacccuggugguggagaaccccacgccggaccaggucgccaccgggaccgaccuccuguucaacaucaccuggcuguccaaccgggccaacaaccgcuucaaccccugggugauccccaacuacggcagcacgcugaccgaggccgcccagcucgcccccuccaucuucccgcccggguucggcgagaccaucguguacuucaacagcaccuuccccgcggucggcgccacgacccacgccgccauccccugccugcugccgcaggaguucguggcccacuucgugaacgagcaggcgcccauccgcggggaggccgcccuccugcacuacaucgaccccgacacccaccggaaccugggcgaguucaagaucuaccccgagggguucgugaccugcgugccgaacgugggcgggacgggcccccagucccuccccaccaacggcgucuucguguucgugagcugggucucccgguacuaccagcugaagcccguggggaccgccggccaggcccgccggcuguga

SEQ ID NO: 11256 - RNA, 1629 nt, Artificial Sequence
  derived and/or modified sequence opt1 from VP1__Norovirus_and/or_Norovirus-like__AY134748
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccaggacaacgaccaccuguacaacaucaccaucaccaaccugaacgggagccccuucgacccguccgaggacauccccgcgccccucggcgucccggacuuccaggggcggguguucggcgugaucacgcagcgcgacaagcagaacgcggccgggcagagccagcccgccaaccggggccacgacgccgucgugcccaccuacaccgcccaguacacccccaagcugggccaggugcagaucgggacguggcagaccgacgaccugaaggucaaccagccggugaaguucacccccgugggccucaacgacaccgagcacuucaaccagugggucgugccccgcuacgcgggggcccugaaccugaacacgaaccucgcccccuccguggccccggucuuccccggcgagcggcugcuguucuuccgcagcuaccucccccugaagggcggguacggcaaccccgcgaucgacugccugcucccgcaggagugggugcagcacuucuaccaggaggccgcccccagcauguccgagguggcccugguccgguacaucaaccccgacaccgggcgcgcccuguucgaggcgaagcuccaccgggccggcuucaugaccgugagcuccaacaccagcgcccccguggucgugccggccaacggguacuuccgcuucgacuccugggugaaccaguucuacagccuggcccccaugggcacggggaacggccggcgccgcauccaguga

SEQ ID NO: 11257 - RNA, 1629 nt, Artificial Sequence
  derived and/or modified sequence opt1 from VP1__Norovirus_and/or_Norovirus-like__AY054300
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccguccccaucgaccagauguucaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagcccguucgaccccuccgaggacauccccgccccgcucggcgugcccgacuuccaggggcggguguucggcgucaucagccagcgcgacaagcagaacgcggccgggcacuccgagcccgccaaccggggccacgacgccguggugcccacguacaccgcccaguacaccccgaagcugggccagauccagaucgggaccuggcagacggacgaccugcaggucaaccagcccgugaaguucacccccgugggccucaacgacaccgagcacuucaaccagugggucgugccccgcuacgcgggggcccugaaccugaacaccaaccucgccccgagcguggcccccgucuuccccggcgagcggcugcuguucuuccgcagcuaccucccccugaagggcggguacggcaacccggcgaucgacugccugcucccccaggagugggugcagcacuucuaccaggaggccgcccccuccaugagcgagguggcccugguccgguacaucaaccccgacacggggcgcgcccuguucgaggcgaagcuccaccgggccggcuucaugaccguguccagcaacaccuccgccccgguggucgugcccgccaacggguacuuccgcuucgacagcugggugaaccaguucuacucccuggcccccaugggcaccgggaacggccggcgccgcguccaguga

SEQ ID NO: 11258 - RNA, 1629 nt, Artificial Sequence
  derived and/or modified sequence opt1 from VP1__Norovirus_and/or_Norovirus-like__KY485125
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgagaucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgugaccaucaccaaccugaacgggagccccuucgacccguccgaggacauccccgcgccccucggcgucccggacuuccaggggcggguguucggcaucaucagccagcgcgacaagcacaacucccccgggcacaacgagcccgcgaaccggggccacgacgccgugguccccacguacaccgcccaguacaccccgaagcugggccagauccagaucgggaccuggcagacggacgaccugaccgugaaccagcccgugaaguucacccccgucggccucaacgacaccgagcacuucaaccaguggguggugccccgcuacgccggggcccugaaccugaacacgaaccucgcgccgagcgucgcccccguguuccccggcgagcggcugcuguucuuccgcagcuacaucccccucaagggcggguacggcaacccggccaucgacugccugcugccccaggagugggugcagcacuucuaccaggaggccgcgcccuccaugagcgaggucgcccucgugcgguacaucaaccccgacaccgggcgcgcccuguucgaggccaagcugcaccgggccggcuucaugaccguguccagcaacaccuccgcgccggucguggugcccgccaacggguacuuccgcuucgacagcugggucaaccaguucuacucccucgcccccaugggcacggggaacggccggcgccgcgugcaguga

SEQ ID NO: 11259 - RNA, 1629 nt, Artificial Sequence
  derived and/or modified sequence opt1 from VP1__Norovirus_and/or_Norovirus-like__KY485123
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggccacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcaucaucagccagcgcgacaagcacaacucccccgggcacaacgagcccgcgaaccggggccacgacgccgucgugcccacguacaccgcccaguacaccccgaagcugggccagauccagaucgggaccuggcagacggacgaccugaccgugaaccagcccgucaaguucacccccgugggccucaacgacaccgagcacuucaaccaguggguggucccccgcuacgccggggcccugaaccugaacacgaaccucgcgccgagcguggcccccguguuccccggcgagcggcugcuguucuuccgcagcuacaucccccucaagggcggguacggcaacccggccaucgacugccugcugccccaggaguggguccagcacuucuaccaggaggccgcgcccuccaugagcgagguggcccucgugcgguacaucaaccccgacaccgggcgcgcccuguucgaggccaagcugcaccgggccggcuucaugaccgucuccagcaacaccuccgcgccgguggugguccccgccaacggguacuuccgcuucgacagcugggugaaccaguucuacucccucgcccccaugggcacggggaacggccggcgccgcgugcaguga

SEQ ID NO: 11260 - RNA, 1629 nt, Artificial Sequence
  derived and/or modified sequence opt1 from VP1__Norovirus_and/or_Norovirus-like__KY485126
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgagaucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgugaccaucaccaaccugaacgggagccccuucgacccguccgaggacauccccgcgccccucggcgucccggacuuccaggggcggguguucggcaucaucagccagcgcgacaagcacaacucccccgggcacaacgagcccgcgaaccggggccacgacgccgugguccccacguacaccgcccaguacaccccgaagcugggccagauccagaucgggaccuggcagacggacgaccugaccgugaaccagcccgugaaguucacccccgucggccucaacgacaccgagcacuucaaccaguggguggugccccgcuacgccggggcccugaaccugaacaucaaccucgcgccgagcgucgcccccguguuccccggcgagcggcugcuguucuuccgcagcuacaucccccucaagggcggguacggcaacccggccaucgacugccugcugccccaggagugggugcagcacuucuaccaggaggccgcgcccuccaugagcgaggucgcccucgugcgguacaucaaccccgacacggggcgcgcccuguucgaggccaagcugcaccgggccggcuucaugaccguguccagcaacaccuccgcgccggucguggugcccgccaacggguacuuccgcuucgacagcugggucaaccaguucuacucccucgcccccaugggcaccgggaacggccggcgccgcgugcaguga

SEQ ID NO: 11261 - RNA, 1629 nt, Artificial Sequence
  derived and/or modified sequence opt1 from VP1__Norovirus_and/or_Norovirus-like__U70059
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccagcaagggcgaggugaccgcccaccuccaggacaacgaccaccuguacaacaucaccaucaccaaccugaacgggucccccuucgacccgagcgaggacauccccgcgccccucggcgucccggacuuccaggggcggguguucggcgugaucacgcagcgcgacaagcagaacgcggccgggcagucccagcccgccaaccggggccacgacgccgucgugcccaccuacaccgcccaguacacccccaagcugggccaggugcagaucgggacguggcagaccgacgaccugaaggucaaccagccggugaaguucacccccgugggccucaacgacaccgagcacuucaaccagugggucgugccccgcuacgcgggggcccugaaccugaacacgaaccucgcccccagcguggccccggucuuccccggcgagcggcugcuguucuuccgcagcuaccucccccugaagggcggguacggcaaccccgcgaucgacugccugcucccgcaggagugggugcagcacuucuaccaggaggccgcccccuccaugagcgagguggcccugguccgguacaucaaccccgacaccgggcgcgcccuguucgaggcgaagcuccaccgggccggcuucaugaccguguccagcaacaccuccgcccccguggucgugccggccaacggguacuuccgcuucgacagcugggugaaccaguucuacucccuggcccccaugggcacggggaacggccggcgccgcguccaguga

SEQ ID NO: 11262 - RNA, 1629 nt, Artificial Sequence
  derived and/or modified sequence opt1 from VP1__Norovirus_and/or_Norovirus-like__LC145808
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacgcccccgggcacaacgagcccgccaaccgggcccacgacgccguggugcccacguacaccgcccaguacaccccgaagcugggccagauccagaucggcaccuggcagacggacgaccugaccgucaaccagcccgugaaguucacccccguggggcucaacgacaccgaccacuucaaccagugggucgugccccgcuacgccggcgcgcugaaccugaacacgaaccucgccccgagcguggcccccgucuuccccggggagcggcugcuguucuuccgcagcuacaucccccucaagggcggguacggcaccccggccaucgacugccugcugccccaggagugggugcagcacuucuaccaggaggcggcccccuccaugagcgagguggcccucguccgguacaucaaccccgacaccggccgcgcccuguucgaggccaagcugcaccgggcgggguucaugaccguguccagcaacacguccgccccgguggucgugcccgccaacggcuacuuccgcuucgacagcugggugaaccaguucuacucccucgcccccauggggaccggcaacgggcggcgccgcauccaguga

SEQ ID NO: 11263 - RNA, 1629 nt, Artificial Sequence
  derived and/or modified sequence opt1 from VP1__Norovirus_and/or_Norovirus-like__LC145795
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccaucaaccagcccgucaaguucacccccguggggcucaacgacacggaccacuucaaccaguggguggucccccgcuacgccggcgcccugaaccugaacaccaaccucgcgccgagcguggcccccguguuccccggggagcggcugcuguucuuccgcagcuacaucccccucaagggcggguacggcaccccggccaucgacugccugcugccccaggaguggguccagcacuucuaccaggaggccgcgcccuccaugagcgagguggcccucgugcgguacaucaaccccgacaccggccgcgcccuguucgaggccaagcugcaccgggccggguucaugacggucuccagcaacaccuccgcgccgguggugguccccgccaacggcuacuuccgcuucgacagcugggugaaccaguucuacucccucgcccccauggggaccggcaacgggcggcgccgcauccaguga

SEQ ID NO: 11264 - RNA, 1629 nt, Artificial Sequence
  derived and/or modified sequence opt1 from VP1__Norovirus_and/or_Norovirus-like__AB629941
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgccucuacaacggcuacgccgggggcauggagguccaggugaugcuggcggggaacgccuucaccgccggcaagcugguguuccccgccgucccgccccacuuccccaucgagaaccucagcccccagcagaucaccauguucccccacgugaucaucgacgugcggacgcuggagcccguccugcucccgcugcccgacgugcgcaacaacuucuuccacuacaaccagaaggacgaccccaagaugcggaucguggcgaugcuguacacgccccuccgcuccaacgggagcggcgacgacgucuucaccguguccugccgggugcugacccgcccgagccccgacuucgacuucaccuaccuggucccgcccaccguggaguccaagaccaagcccuucacccuccccauccugacgcugggcgagcucagcaacucccgguuccccgugagcaucgaccagauguacaccucccccaacgaggucaucagcgugcagugccagaacgggcgcugcacccuggacggcgagcugcaggggaccacgcagcuccagguguccggcaucugcgccuucaagggcgaggucaccgcccaccuccacgacaacgaccaccuguacaacaucaccaucaccaaccucaacgggagcccguucgaccccuccgaggacauccccgccccgcugggcgugcccgacuuccaggggcgggucuucggcaucaucagccagcgcgacaagcacaacucccccgggcacaacgagcccgccaaccggggccacgacgcgguggugccgacguacaccgcccaguacacccccaagcugggccagauccagaucgggaccuggcagacggacgaccucaccgucagccagcccgugaaguucacccccgugggccugaacgacaucgagcacuucaaccagugggucgugccgcgcuacgccggggcccugaaccucaacaccaaccuggcccccagcguggcgcccgucuuccccggcgagcggcugcuguucuuccgcuccuacaucccgcugaagggcggguacggcaaccccgccaucgacugccugcucccccaggagugggugcagcacuucuaccaggaggccgcccccagcauguccgagguggcgcugguccgguacaucaacccggacacggggcgcgcccuguucgaggccaagcuccaccgggccggcuucaugaccgugagcuccaacaccagcgcccccguggucgugcccgcgaacggguacuuccgcuucgacuccugggugaaccaguucuacagccuggcccccaugggcaccgggaacggccggcgccgcguccaguga

SEQ ID NO: 11265 - RNA, 1629 nt, Artificial Sequence
  derived and/or modified sequence opt1 from VP1__Norovirus_and/or_Norovirus-like__LC145792
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccaguggguccugccccgcuacgccggcgcccugaaccucaacaccaaccuggcgccgagcguggcccccguguuccccggggagcggcuccuguucuuccgcagcuacaucccccugaagggcggguacggcaccccggccaucgacugccugcucccccaggaguggguccagcacuucuaccaggaggccgcgcccuccaugagcgagguggcccuggugcgguacaucaaccccgacaccggccgcgcccuguucgaggccaagcuccaccgggccggguucaugacggucuccagcaacaccuccgcgccgguggugguccccgccaacggcuacuuccgcuucgacagcugggugaaccaguucuacucccuggcccccauggggaccggcaacgggcggcgccgcauccaguga

SEQ ID NO: 11266 - RNA, 1629 nt, Artificial Sequence
  derived and/or modified sequence opt1 from VP1__Norovirus_and/or_Norovirus-like__LC145786
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacagccagaaggacgaccccaagaugcggaucgucgcgaugcuguacacgccccugcgcuccaacggguccggcgacgacguguucaccguguccugccggguccucacccgccccagccccgacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccagugggucgugccccgcuacgccggcgcccugaaccugaacaccaaccucgcgccgagcguggcccccgucuuccccggggagcggcugcuguucuuccgcuccuacaucccccucaagggcggguacggcaccccggccaucgacugccugcugccccaggagugggugcagcacuucuaccaggaggccgcgcccagcauguccgagguggcccucguccgguacaucaaccccgacaccggccgcgcccuguucgaggccaagcugcaccgggccggguucaugacggugagcuccaacaccagcgcgccgguggucgugcccgccaacggcuacuuccgcuucgacuccugggugaaccaguucuacagccucgcccccauggggaccggcaacgggcggcgccgcauccaguga

SEQ ID NO: 11267 - RNA, 1629 nt, Artificial Sequence
  derived and/or modified sequence opt1 from VP1__Norovirus_and/or_Norovirus-like__LC145793
augaagauggccagcaacgacgccgcgcccuccaccgacggcgccgccgggcuggugccggagagcaacaacgaggucauggcccucgagcccguggccggcguggcgcuggccgcccccgucaccgggcagacgaacaucaucgaccccuggauccgcgccaacuucgugcaggcgccgaacggcgaguucaccgugagcccccggaacucccccggggagguccugcucaaccuggagcugggccccgagcucaacccguaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccccucccggacguccgcaacaacuucuuccacuacaaccagaaggacgaccccaagaugcggaucguggccaugcuguacacgccccugcgcuccaacggguccggcgacgacguguucaccgucagcugccgggugcucacccgccccuccccggacuucgacuucaccuaccuggugccgcccaccgucgagagcaagaccaagcccuucacccugcccauccucacgcugggcgagcuguccaacagccgguuccccguguccaucgaccagauguacaccagccccaacgaggugaucuccguccagugccagaacgggcgcugcacccucgacggcgagcugcaggggaccacgcagcugcaggucagcggcaucugcgcguucgagggcgaggugaccgcccaccuccacgacaacgaccaccuguacaacgugaccaucaccaaccugaacgggucccccuucgacccgagcgaggacauccccgcgccccucggcgugccggacuuccaggggcgggucuucggcgugaucucccagcgcgacaagcacaacacgcccgggcacaacgagcccgccaaccgggcccacgacgccgugguccccaccuacaccgcccaguacaccccgaagcugggccagauccagaucggcacguggcagaccgacgaccugaccgugaaccagcccgugaaguucacccccgucgggcucaacgacacggaccacuucaaccaguggguggugccccgcuacgccggcgcccugaaccugaacaccaaccucgccccgagcgucgcgcccguguuccccggggagcggcugcuguucuuccgcagcuacaucccccucaagggcggguacggcaccccggccaucgacugccugcugccccaggagugggugcagcacuucuaccaggaggccgcccccuccaugagcgaggucgcgcucgugcgguacaucaaccccgacaccggccgcgcccuguucgaggccaagcugcaccgggccggguucaugacgguguccagcaacaccuccgccccggucguggugcccgcgaacggcuacuuccgcuucgacagcugggucaaccaguucuacucccucgcccccauggggaccggcaacgggcggcgccgcauccaguga

SEQ ID NO: 11268 - RNA, 1629 nt, Artificial Sequence
  derived and/or modified sequence opt1 from VP1__Norovirus_and/or_Norovirus-like__LC145791
augaagauggccagcaacgacguggcccccuccaccgacggcgcggccgggcuggucccggagagcaacaacgaggugauggcccucgagcccguggccggcgccgcgcuggccgcccccgucaccgggcagacgaacaucaucgaccccuggauccgcgccaacuucgugcaggcgccgaacggcgaguucaccgugagcccccggaacucccccggggagguccugcucaaccuggagcugggccccgagcucaacccguaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccccucccggacguccgcaacaacuucuuccacuacaaccagaaggacgaccccaagaugcggaucguggccaugcuguacacgccccugcgcuccaacggguccggcgacgacguguucaccgucagcugccgggugcucacccgccccuccccggacuucgacuucaccuaccuggugccgcccaccgucgagagcaagaccaagcccuucacccugcccauccucacgcugggcgagcuguccaacagccgguuccccguguccaucgaccagauguacaccagccccaacgaggugaucuccguccagugccagaacgggcgcugcacccucgacggcgagcugcaggggaccacgcagcugcaggucagcggcaucugcgcguucaagggcgaggugaccgcccaccuccacgacaacgaccaccuguacaacgugaccaucaccaaccugaacgggucccccuucgacccgagcgaggacauccccgcgccccucggcgugccggacuuccaggggcgggucuucggcgugaucucccagcgcgacaagcacaacacgcccgggcacaacgagcccgccaaccgggcccacgacgccgugguccccaccuacaccgcccaguacaccccgaagcugggccagauccagaucggcacguggcagaccgacgaccugaccgugaaccagcccgugaaguucacccccgucgggcucaacgacacggaccacuucaaccaguggguggugccccgcuacgccggcgcccugaaccugaacaccaaccucgccccgagcgucgcgcccguguuccccggggagcggcugcuguucuuccgcagcuacaucccccucaagggcggguacggcaccccggccaucgacugccugcugccccaggagugggugcagcacuucuaccaggaggccgcccccuccaugagcgaggucgcgcucgugcgguacaucaaccccgacaccggccgcgcccuguucgaggccaagcugcaccgggccggguucaugacgguguccagcaacaccuccgccccggucguggugcccgcgaacggcuacuuccgcuucgacagcugggucaaccaguucuacucccucgcccccauggggaccggcaacgggcggcgccgcauccaguga

SEQ ID NO: 11269 - RNA, 1629 nt, Artificial Sequence
  derived and/or modified sequence opt1 from VP1__Norovirus_and/or_Norovirus-like__LC145788
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccuggccgucaaccagcccgugaaguucacccccguggggcucaacgacaccgaccacuucaaccagugggucgugccccgcuacgccggcgcgcugaaccugaacacgaaccucgccccgagcguggcccccgucuuccccggggagcggcugcuguucuuccgcagcuacaucccccucaagggcggguacggcaccccggccaucgacugccugcugccccaggagugggugcagcacuucuaccaggaggcggcccccuccaugagcgagguggcccucguccgguacaucaaccccgacaccggccgcgcccuguucgaggccaagcugcaccgggcgggguucaugaccguguccagcaacacguccgccccgguggucgugcccgccaacggcuacuuccgcuucgacagcugggugaaccaguucuacucccucgcccccauggggaccggcaacgggcggcgccgcauccaguga

SEQ ID NO: 11270 - RNA, 1629 nt, Artificial Sequence
  derived and/or modified sequence opt1 from VP1__Norovirus_and/or_Norovirus-like__LC145803
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacggguccagcuucgaccccuccgaggacaucccggcgccccucggcauccccgacuuccaggggcggguguucggcgugaucagccagcgcgacaagcacaacacgccggggcacaacgagcccgccaaccgggcccacgacgccgucgugcccaccuacaccgcccaguacacccccaagcugggccagauccagaucggcacguggcagaccgacgaccugaccgugaaccagccggucaaguucacccccguggggcucaacgacacggaccacuucaaccaguggguggucccccgcuacgccggcgcccugaaccugaacaccaaccucgcgcccagcguggccccgguguuccccggggagcggcugcuguucuuccgcuccuacaucccccucaagggcggguacggcacccccgccaucgacugccugcugccgcaggaguggguccagcacuucuaccaggaggccgcgcccagcauguccgagguggcccucgugcgguacaucaaccccgacaccggccgcgcccuguucgaggccaagcugcaccgggccggguucaugacggucagcuccaacaccagcgcgcccgugguggucccggccaacggcuacuuccgcuucgacuccugggugaaccaguucuacagccucgcccccauggggaccggcaacgggcggcgccgcauccaguga

SEQ ID NO: 11271 - RNA, 1629 nt, Artificial Sequence
  derived and/or modified sequence opt1 from VP1__Norovirus_and/or_Norovirus-like__LC145804
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaacuucguccaggccccgaacggcgaguucaccgugagcccccggaacucccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacacgcccgggcacaacgagcccgccaaccgggcccacgacgccguggugcccaccuacaccgcccaguacaccccgaagcugggccagauccagaucggcacguggcagaccgacgaccuggccgucaaccagcccgugaaguucacccccguggggcucaacgacaccgaccacuucaaccagugggucgugccccgcuacgccggcgcgcugaaccugaacacgaaccucgccccgagcguggcccccgucuuccccggggagcggcugcuguucuuccgcuccuacaucccccucaagggcggguacggcaccccggccaucgacugccugcugccccaggagugggugcagcacuucuaccaggaggcggcccccagcauguccgagguggcccucguccgguacaucaaccccgacaccggccgcgcccuguucgaggccaagcugcaccgggcgggguucaugaccgugagcuccaacacgagcgccccgguggucgugcccgccaacggcuacuuccgcuucgacuccugggugaaccaguucuacagccucgcccccauggggaccggcaacgggcggcgccgcauccaguga

SEQ ID NO: 11272 - RNA, 1629 nt, Artificial Sequence
  derived and/or modified sequence opt1 from VP1__Norovirus_and/or_Norovirus-like__LC145801
augaagauggccagcaacgacgccgcgcccuccaccgacggcgccgccgggcuggugccggagagcaccaacgaggucauggcccucgagcccguggccggcgcggcccuggccgcccccgugacggggcagaccaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucacgauguucccccacgugaucaucgacguccggacccucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacgcugcccauccucacccugggcgagcuguccaacagccgguuccccgucuccaucgaccagauguacaccagccccaacgaggugaucuccgugcagugccagaacgggcgcugcacccucgacggcgagcugcaggggacgacccagcugcaggucagcggcaucugcgccuucaagggcgaggugaccgcccaccuccacgacaacgaccaccuguacaacgucaccaucacgaaccugaacgggucccccuucgacccgagcgaggacauccccgcgccccucggcgccccggacuuccaggggcggguguucggcgugaucucccagcgcgacaagcacaacacccccgggcacaacgagcccgccaaccgggcccacgacgccgucgugcccaccuacaccgcccaguacacgccgaagcugggccagauccagaucggcaccuggcagaccgacgaccugaccgugaaccagcccgucaaguucacgcccguggggcucaacgacaccgaccacuucaaccaguggguggucccccgcuacgccggcgcgcugaaccugaacaccaaccucgccccgagcguggcccccguguuccccggggagcggcugcuguucuuccgcagcuacaucccccucaagggcggguacggcaccccggccaucgacugccugcugccccaggaguggguccagcacuucuaccaggaggcggcccccuccaugagcgagguggcccucgugcgguacaucaaccccgacacgggccgcgcccuguucgaggccaagcugcaccgggcgggguucaugaccgucuccagcaacaccuccgccccgguggugguccccgccaacggcuacuuccgcuucgacagcugggugaaccaguucuacucccucgcccccauggggaccggcaacgggcggcgccgcauccaguga

SEQ ID NO: 11273 - RNA, 1629 nt, Artificial Sequence
  derived and/or modified sequence opt1 from VP1__Norovirus_and/or_Norovirus-like__LC145802
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggccacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgaguucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggccagcggcaucugcgccuucaagggcgaggucaccgcccaccuccacgacaacgaccaccuguacaacgugaccaucaccaaccugaacgggucccccuucgacccgagcgaggacauccccgcgccccucggcgucccggacuuccaggggcggguguucggcgugaucucccagcgcgacaagcacaacgcccccgggcacaacgagcccgccaaccgggcccacgacgccgucgugcccacguacaccgcccaguacaccccgaagcugggccagauccagaucggcaccuggcagacggacgaccugaccgugaaccagcccgucaaguucacccccguggggcucaacgacaccgaccacuucgaccaguggguggucccccgcuacgcgggcgcccugaaccugaacacgaaccucgccccgagcguggcccccguguuccccggggagcggcugcuguucuuccgcagcuacaucccccucaagggcggguacggcaccccggcgaucgacugccugcugccccaggaguggguccagcacuucuaccaggaggccgcccccuccaugagcgagguggcccucgugcgguacaucaaccccgacaccggccgcgcccuguucgaggcgaagcugcaccgggccggguucaugaccgucuccagcaacacguccgccccgguggugguccccgccaacggcuacuuccgcuucgacagcugggugaaccaguucuacucccucgcccccauggggaccggcaacgggcggcgccgcauccaguga

SEQ ID NO: 11274 - RNA, 1629 nt, Artificial Sequence
  derived and/or modified sequence opt1 from VP1__Norovirus_and/or_Norovirus-like__LC145805
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaacuucguccaggccccgaacggcgaguucaccgugagcccccggaacucccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacacgcccgggcacaacgagcccgccaaccgggcccacgacgccguggugcccaccuacaccgcccaguacaccccgaagcugggccagauccagaucggcacguggcagaccgacgaccuggccgucaaccagcccgugaaguucacccccguggggcucaacgacaccgaccacuucaaccagugggucgugccccgcuacgccggcgcgcugaaccugaacacgaaccucgccccgagcguggcccccgucuuccccggggagcggcugcuguucuuccgcuccuacaucccccucaagggcggguacggcaccccggccaucgacugccugcugccccaggagugggugcagcacuucuaccaggaggcggcccccagcauguccgagguggcccucguccgguacaucaaccccgacaccggccgcgcccuguucgaggccaagcugcaccgggugggguucaugaccgugagcuccaacacgagcgcgccggucguggugcccgccaacggcuacuuccgcuucgacuccugggucaaccaguucuacagccucgcccccauggggaccggcaacgggcggcgccgcauccaguga

SEQ ID NO: 11275 - RNA, 1629 nt, Artificial Sequence
  derived and/or modified sequence opt1 from VP1__Norovirus_and/or_Norovirus-like__LC145797
augaagauggccagcaacgacgccgcgcccuccaccgacggcgccgccgggcuggugccggagagcaacaacgaggucauggcccucgagcccguggccggcguggcgcuggccgcccccgucaccgggcagacgaacaucaucgaccccuggauccgcgccaacuucgugccggcgcccaacggcgaguucaccgugagcccccggaacucccccggggagguccugcucaaccuggagcugggcccggagcucaaccccuaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccgcuccccgacguccgcaacaacuucuuccacuacaaccagaaggacgaccccaagaugcggaucguggccaugcuguacacgccccugcgcuccaacggguccggcgacgacguguucaccgucagcugccgggugcucacccgcccgucccccgacuucgacuucaccuaccuggugccgcccaccgucgagagcaagaccaagcuguucacccuccccauccugacgcugggcgagcucuccaacagccgguuccccguguccaucgaccagauguacaccagccccaacgaggugaucuccguccagugccagaacgggcgcugcacccuggacggcgagcugcaggggaccacgcagcuccaggugagcggcaucugcgcguucaagggcgaggucaccgcccaccuccacgacaacgaccaccuguacaacgugaccaucaccaaccucaacgggucccccuucgacccgagcgaggacauccccgcgccccugggcgugccggacuuccaggggcgggucuucggcgugaucucccagcgcgacaagcacaacaucagcgggcacaacgagcccgccaaccgggcccacgacgccgugguccccacguacaccgcccaguacacccccaagcugggccagauccagaucggcaccuggcagacggacgaccucaccgugaaccagccggugaaguucacccccgucgggcugaacgacaccgaccacuucaaccaguggguggugccccgcuacgccggcgcccugaaccucaacacgaaccuggcccccagcgucgcgccgguguuccccggggagcggcugcuguucuuccgcuccuacaucccccugaagggcggguacggcacccccgccaucgacugccugcucccgcaggagugggugcagcacuucuaccaggaggccgcccccagcauguccgaggucgcgcuggugcgguacaucaaccccgacaccggccgcgcccuguucgaggccaagcuccaccgggccggguucaugaccgugagcuccaacacgagcgcccccgucguggugccggcgaacggcuacuuccgcuucgacuccugggucaaccaguucuacagccuggcccccauggggaccggcaacgggcggcgccgcauccaguga

SEQ ID NO: 11276 - RNA, 1629 nt, Artificial Sequence
  derived and/or modified sequence opt1 from VP1__Norovirus_and/or_Norovirus-like__LC145806
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaucuucguccaggccccgaacggcgaguucaccgugagcccccggaacucccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacacgcccgggcacaacgagcccgccaaccgggcccacgacgccguggugcccaccuacaccgcccaguacaccccgaagcugggccagauccagaucggcacguggcagaccgacgaccuggccgucaaccagcccgugaaguucacccccguggggcucaacgacaccgaccacuucaaccagugggucgugccccgcuacgccggcgcgcugaaccugaacacgaaccucgccccgagcguggcccccgucuuccccggggagcggcugcuguucuuccgcuccuacaucccccucaagggcggguacggcaccccggccaucgacugccugcugccccaggagugggugcagcacuucuaccaggaggcggcccccagcauguccgagguggcccucguccgguacaucaaccccgacaccggccgcgcccuguucgaggccaagcugcaccgggcgggguucaugaccgugagcuccaacacgagcgccccgguggucgugcccgccaacggcuacuuccgcuucgacuccugggugaaccaguucuacagccucgcccccauggggaccggcaacgggcggcgccgcauccaguga

SEQ ID NO: 11277 - RNA, 1629 nt, Artificial Sequence
  derived and/or modified sequence opt1 from VP1__Norovirus_and/or_Norovirus-like__KU306738
augaagauggccagcaacgacgccgcgcccuccaacgacggcgccagcucccuggugccggagaucaacaacgagaccauggcccucgagcccgucgccgggggcgccaucgcggcgccccugaccgggcagacgaacuucaucgaccccuggauccgcaacaacuacgugcaggccccgaacggcgaguucaccaucagcccccggaacucccccggggagauccugcucaaccuggagcugggccccgagcucaacccguuccuggcccaccuggcccgcauguacaacggcuacgccgggggcguggacguccaggugaucauggccgggaacgccuucaccgccggcaaggugaucuucgcggccgucccgccccacuuccccguggagagccucuccccgccccagaucaccauguucccccacaucaucguggacguccggacgcuggagcccaucaacauccccauccccgacgugcgcaacaacuucuuccacuacaaccagaacaacgagccccggaugcgccugguggccaugcucuacacgccccugcggagcaacggguccgccgacgacgucuucaccgugagcugccgcgugcugaccaagccguccgccgacuucgaguucaacuaccucgucccgcccaccguggagagccggaccaagcccuucaccauccccauccugaccaucggcgagaugacgaacucccgcuuccccguggcgaucgacaugcuguacaccagccccaccgagaaccucgucgugcagccccagaacggccggugcacccuggagggggagcugcucggcacgacccagcuggugaccccgaacaucugcucccugcgcggggccaucaccggccacgagggcaacgacgacaaccacaaguggcacaugacggucaccaaccccaacgggagcgccuucgaccccaccgaggacgugccggcgccccucggcacccccgacuucaucggggacguguacggcguccugucccagcggaaccgcaacaucgagagcgggcagacggcccccgccaaccggucccacgaggccgugaucagcacccgcagcaacaaguucaccccgaagcugggcuccgucaugaucgccaccuggaacacgaacgacguggagaaccagcccaccaaguucacccccgugggccucgagaaccccgggagcuuccaccagugggagcugccgaacuacuccggcgcccugacccucaacauggggcuggccccgcccgucuuccccacguaccccggcgagcagcuccuguucuuccggagcuacaucccccugaagggcggguucggcaacuccaucaucgacugccuggugccccaggaguggauccagcacuucuaccaggagagcgcgcccucccagaccgacguggcccucauccgcuacgucaacccggagaccgggcgggugcuguucgaggccaagcugcaccgccagggcuucaucaccguggccaagacgggggacagccccaucaacguccccgcgaacggcuacuuccgguucgacuccugggugaacagcuucuacucccucgcccccauggggaccggcaacggccgccgccggauccaguga

SEQ ID NO: 11278 - RNA, 1629 nt, Artificial Sequence
  derived and/or modified sequence opt1 from VP1__Norovirus_and/or_Norovirus-like__KM036380
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggccgcuucacccccaagaucggcaccaucgggcugcacagcaucaccgagaacguccacccgaaccagcagucccgguucacgcccgugggcguggcccagaacgagaacacccccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacacgggccgcacccucuucgaggcgaagcugcaccggagcggguucaucaccgugucccacaccggcaacuacccccugguggucccgcccaacgggcacuuccgcuucgacagcugggugaaccaguucuacucccucgcccccaugggcacggggaacggccgccggcgcgugcaguga

SEQ ID NO: 11279 - RNA, 1629 nt, Artificial Sequence
  derived and/or modified sequence opt1 from VP1__Norovirus_and/or_Norovirus-like__AY113106
augaagauggccagcaacgacgccgcgcccuccaacgacggcgccgccagccuggugccggaggggaucaacgagaccaugccccucgagcccgucgccggcgccuccaucgcggcccccguggccgggcagaccaacaucaucgacccguggauccgcacgaacuucgugcaggcccccaacggcgaguucaccgucagcccccggaacucccccggggagauccugcugaaccucgagcugggcccggaccugaaccccuaccucgcgcaccugagccgcauguacaacggcuacgccgggggcguggaggugcagguccugcucgccgggaacgccuucaccgccggcaagauccuguucgcggccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggguccggcgacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcccccaacgagaccaacgucgugcagugccagaacggccggugcacccucgacggggagcugcagggcacgacccagcugcucuccagcgcggugugcuccuaccgcgggcggaccgucgccaacaacggcgacaacugggaccagaaccugcugcagcucaccuaccccaacggcgccagcuacgacccgacggacgaggugcccgcgccccuggggacccaggacuucuccggcaugcuguacggggugcucacccaggacaacgucaacgugagcaccggcgaggccaagaacgccaaggggaucuacaucagcacgaccuccggcaaguucacccccaaggucggcagcaucgggcugcacuccaucaccgagcacgugcacccgaaccagcagagccgcuucacgcccgugggcgucgccgugaacgagaacacccccuuccagcagugggugcugccccacuacgccgggucccucgcccugaacaccaaccuggccccggcggucgcccccaccuuccccggcgagcagcuccuguucuuccggagccgcgugcccugcgugcaggggcugcagggccaggacgccuucaucgacugccuccugccgcaggagugggucaaccacuucuaccaggaggccgcgcccucccaggccgacguggcccugauccgguacgugaaccccgacacgggccgcacccucuucgaggccaagcugcaccggagcggguucaucaccgucucccacaccggcgccuacccccugguggugccgcccaacgggcacuuccgcuucgacagcugggucaaccaguucuacucccucgcgcccaugggcacggggaacggccggcgccgcauccaguga

SEQ ID NO: 11280 - RNA, 1629 nt, Artificial Sequence
  derived and/or modified sequence opt1 from VP1__Norovirus_and/or_Norovirus-like__AB078334
augaagauggccagcaacgacgccgcgcccuccaacgacggcgccgccagccuggugccggaggggaucaacgagaccaugccccucgagcccgucgccggcgccuccaucgcggcccccguggccgggcagaccaacaucaucgacccguggauccgcacgaacuucgugcaggcccccaacggcgaguucaccgucagcccccggaacucccccggggagauccugcugaaccucgagcugggcccggaccugaaccccuaccucgcgcaccugagccgcauguacaacggcuacgccgggggcguggaggugcagguccugcucgccgggaacgccuucaccgccggcaagauccuguucgcggccaucccgcccaacuuccugguggacaugaucucccccgcccagaucaccaugcucccccaccugaucguggacguccggacgcuggagcccaucaugacgccccucccggacgugcgcaacguguucuaccacuucaacaaccagccccagccccggaugcgccuggucgccaugcuguacacgccccuccggagcaacggguccggcgacgacguguucaccgugagcugccgcguccugacccggccgacccccgacuucgaguucaucuaccuggugccgcccuccguggagagcaagaccaagcccuucacccuccccauccugaccaucuccgagcugaccaacagccgcuuccccauccccaucgagcagcucuacaccgccccgaacgagaccaacgucgugcagugccagaacggccggugcacgcuggacggggagcugcagggcaccacccagcuccuguccagcgcggugugcuuccugcaggggcgcaccgucgccgacaacggcgacaacugggaccagaaccuccugcagcugacguaccccaacggcgccuccuacgaccccaccgacgaggugccggcgccccucgggacccaggacuucagcggcaugcuguacggggugcugacccaggacaacgucaacguguccacgggcgaggccaagaacgccaaggggaucuacaucagcaccaccagcggcaaguucacccccaagaucggcuccaucgggcuccacagcaucacggagcacguccaccccaaccagcagucccgguucaccccggugggcguggccgucgacgagaacacccccuuccagcagugggugcugccccacuacgccgggagccuggcccucaacaccaaccuggcccccgcgguggccccgacguuccccggcgagcagcuccuguucuuccgcucccggguccccugcgugcaggggcugcagggccaggacgccuucaucgacugccugcucccccaggagugggugaaccacuucuaccaggaggccgcgccgagccaggccgacgucgcccugauccgcuacgugaaccccgacaccggccggacccuguucgaggccaagcuccaccgcuccggguucaucaccgugagccacacgggcgccuacccccuggucgugcccccgaacgggcacuuccgguucgacuccugggugaaccaguucuacagccuggcgcccaugggcaccgggaacggccgccggcgcauccaguga

SEQ ID NO: 11281 - RNA, 1629 nt, Artificial Sequence
  derived and/or modified sequence opt1 from VP1__Norovirus_and/or_Norovirus-like__KM289172
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaccgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgacaacaucgucgugcagugccagaacgggcgcgugacgcucgacggcgagcugauggggaccacccagcugcuccccucccagaucugcgccuuccggggcguccugacccgcagcacgucccgggcgagcgaccaggccgacaccgccacgccccgccuguucaacuacuacuggcacauccagcucgacaaccugaacggcaccccguacgaccccgccgaggacauccccgccccgcuggggacccccgacuuccggggcaagguguucgggguggcgagccagcgcaaccccgacuccaccacccgggcccacgaggccaaggucgacaccacgagcggccgcuucacccccaagcucgggucccuggagaucagcaccgaguccggcgacuucgaccagaaccagccgacccgguucacgcccgugggcaucggggucgacagcgaggccgacuuccagcaguggacccugcccgacuacuccggccaguucacccacaacaugaaccucgcgcccgccguggccccgaacuuccccggggagcagcugcuguucuuccgcagccagcuccccuccagcggcgggcgguccaacggcauccuggacugccuggugccccaggaguggguccagcacuucuaccaggagagcgccccggcccagacccagguggcgcucgugcgcuacgucaaccccgacacgggccgcgugcuguucgaggccaagcugcacaagcucggguacaugaccaucgccaaguccggcgacagccccaucaccgugcccccgaacggguacuuccgguucgaguccugggucaaccccuucuacacccuggcccccaugggcacggggaacuga

SEQ ID NO: 11282 - RNA, 1629 nt, Artificial Sequence
  derived and/or modified sequence opt1 from VP1__Norovirus_and/or_Norovirus-like__AY130762
augcgcauggccagcuccgacgcccccgugagcggcaccgacggggcggccggccuggucccggagucccagcaggaggugcucccccuggagcccguggccgggguccagcuggccgcccccguggcgggccagagcaacaucaucgacccguggauccggaugaacuucgugcaggcccccgccggggaguucaccgucagcccccgcaacgcccccggcgaggugcucaucgaccuggagcugggcccggagcucaaccccuaccugaaccaccuggcgcggauguacaacggguacgugggcgggauggaggucgagguggugcucgccggcaacgccuucacggccgggaagauccuguucgccgcggucccgcccuccuuccccacccacggcaucuccgccgcccaggccaccaugcugccccacgugaucguggacguccgccagcucgagcccgugcggcugccccugccggacgugcgcaacgucauguuccacuucugccaggagaacaaggagccccggaugcgcaucguggccauccucuacacgccccugcgggcgaacggcgccggggacgacguguucaccgucagcugccgcgugcugacccggcccuccccggacuucgacuucaucuuccucgugccgcccagcgucgaguccaagcugaagcaguucacccugcccaaccuccagcccaacgagaugaccaacagccgcuuccccacgggcaucacccagcuguacaccucccccaacaccaaccuggugguccaguuccagaacgggcggugccuccuggacggcacgcugcucggcaccacccccgugcgcgccgccgacaucugcagcuuccgcggggugaccuccacggaggucgacgccaccgacagcccgcggguggcgggcucccaccggaucauggugcagcugaaggagcccgacggggaggaguucagccccaccggcccgaaccccgcccccgucgggacccccgacuuccaggccgccaucuucggcacgcugucccagcgcaacaccggcggggccggccagaacagcaaccgggcgcacuucgccuacuucuacacccgcaacccgaccuucgcccccgggaucggcacggugguguucagcuucgacaccaccgacuuccagaaccggcagcccaccaaguucucccccagcggggucuucgacgacaacuccagcgagccguucaaccaguucucccuccccuacuacaacggcagccugggcgccguggacgcggggaagcuggccccgcccguggcccccaacuaccccggcgagcagauccucuacuuccgcgggaacauccccuucaagggcggguacggcgagggcgagaucgacucccugcugccccaggaguggaucacgcacuucuacgccgagcaggccccgacccagggggacgcggcccuccugcgcuacuacaaccccgacaccggccggguccuguucgagugcaagcuccaccgcgagggguucaucaccaucaacuacacgggcagcaacgcccuggccgugcccgugaacggcgucuuccgguucgaggggugggugaacaaguucuacacccugacccccauguga

SEQ ID NO: 11283 - RNA, 1629 nt, Artificial Sequence
  derived and/or modified sequence opt1 from VP1__Norovirus_and/or_Norovirus-like__KJ196290
augcgcauggccagcuccgacgcccccgugagcggcaccgacggggcggccggccuggucccggagucccagcaggaggugcucccccuggagcccguggccgggguccagcuggccgcccccguggcgggccagagcaacaucaucgacccguggauccggaugaacuucgugcaggcccccgccggggaguucaccgucagcccccgcaacgcccccggcgaggugcucaucgaccuggagcugggcccggagcucaaccccuaccugaaccaccuggcgcggauguacaacggguacgugggcgggauggaggucgagguggugcucgccggcaacgccuucacggccgggaagauccuguucgccgcggucccgcccuccuuccccacccacggcaucuccgccgcccaggccaccaugcugccccacgugaucguggacguccgccagcucgagcccgugcggcugccccugccggacgugcgcaacgucauguuccacuucugccaggagaacaaggagccccggaugcgcaucguggccauccucuacacgccccugcgggcgaacggcgccggggacgacguguucaccgucagcugccgcgugcugacccggcccuccccggacuucgacuucaucuuccucgugccgcccagcgucgaguccaagcugaagcaguucacccugcccaaccuccagcccaacgagaugaccaacagccgcuuccccacgggcaucacccagcuguacaccucccccaacaccaaccuggugguccaguuccagaacgggcggugccuccuggacggcacgcugcucggcaccacccccgugcgcgccgccgacaucugcagcuuccgcggggugaccuccacggaggucgacgccaccgacagcccgcggguggcgggcucccaccggaucauggugcagcugcgcgagcccgacggggaggaguucagccccaccggcccgaaccccgcccccgucgggacccccgacuuccaggccgccaucuucggcacgcugucccagcggaacaccggcggggccggccagaacagcaaccgcgcgcacuucgccuacuucuacacccggaacccgaccuucgcccccgggaucggcacggugguguucagcuucgacaccaccgacuuccagaaccgccagcccaccaaguucucccccagcggggucuucgacgacgacuccagcgagccguucaaccaguucucccuccccuacuacaacggcagccugggcgccguggacgcggggaagcuggccccgcccguggcccccaacuaccccggcgagcagauccucuacuuccgcggguccguccccuucaagggcggguacggcgagggcgagaucgacagccugcugccccaggaguggaucacgcacuucuacgccgagcaggccccgacccagggggacgcggcccuccugcgguacuacaaccccgacaccggccgcgugcuguucgagugcaagcuccaccgggagggguucaucaccaucaacuacacgggcuccaacgcccuggccgugcccgucaacggcguguuccgcuucgaggggugggugaacaaguucuacacccugacccccauguga

SEQ ID NO: 11284 - RNA, 1629 nt, Artificial Sequence
  derived and/or modified sequence opt1 from VP1__Norovirus_and/or_Norovirus-like__GQ856474
augcgcauggccagcuccgacgcccccgugagcggcaccgacggggcggccggccuggucccggagucccagcaggaggugcucccccuggagcccguggccgggguccagcuggccgcccccguggcgggccagagcaacaucaucgacccguggauccggaugaacuucgugcaggcccccgccggggaguucaccgucagcccccgcgacgcccccggcgaggugcucaucgaccuggagcugggcccggagcucaaccccuaccugaaccaccuggcgcggauguacaacggguacgugggcgggauggaggucgagguggugcucgccggcaacgccuucacggccgggaagauccuguucgccgcggucccgcccuccuuccccacccacggcaucuccgccgcccaggccaccaugcugccccacgugaucguggacguccgccagcucgagcccgugcggcugccccugccggacgugcgcaacgucauguuccacuucugccaggagaacaaggagccccggaugcgcaucguggccauccucuacacgccccugcgggcgaacggcgccggggacgacguguucaccgucagcugccgcgugcugacccggcccuccccggacuucgacuucaucuuccucgugcugcccagcgucgaguccaagcugaagcaguucacccuccccaaccugcagcccaacgagaugaccaacagccgcuucccgacgggcaucauccagcuguacaccucccccaacaccaaccucgugguccaguuccagaacgggcggugccugcuggacggcacccuccugggcacgacccccgugcgcgccgccgacaucugcagcuuccgcggggugaccuccaccgaggucgacgccacggacagcccccggguggcgggcucccaccggaucauggugcagcugaaggagccggacggggaggaguucagccccaccggccccaacccggcccccgucgggacccccgacuuccaggccgccaucuucggcacccucucccagcgcaacacgggcggggccggccagaacagcaaccgggcgcgcuucgccuacuucuacacccggaaccccaccuucgccccggggaucggcaccgugguguucagcuucgacacgaccgacuuccagaaccgccagcccaccaaguucucccccagcggggucuucgacgacgacuccagcgagcccuucaaccaguucucccugccguacuacaacggcagccugggcgccguggacgcggggaagcucgccccgcccguggcccccaacuaccccggcgagcagauccuguacuuccgcgggaacauccccuucaagggcggguacggcgagggcgagaucgacucccugcucccccaggaguggaucacccacuucuacgccgagcaggcccccacgcagggggacgcggcccugcugcgguacuacaacccggacaccggccgcguccucuucgagugcaagcugcaccgggagggguucaucaccaucaacuacaccggcagcaacgcccuggccgugcccgugaacggcgucuuccgcuucgaggggugggugaacaaguucuacacgcucacccccauguga

SEQ ID NO: 11285 - RNA, 1629 nt, Artificial Sequence
  derived and/or modified sequence opt1 from VP1__Norovirus_and/or_Norovirus-like__LC145787
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacgugcccgcgccccucggcgugccggacuuccaggggcgggucuucggcaucaucucccagcgcgacaagcacaacagccccgggcacaacgagcccgcgaaccggggccacgacgccguggugcccacguacaccgcccaguacaccccgaagcugggccagauccagaucgggaccuggcagacggacgaccugaccgucaaccagcccgugaaguucacccccgugggccucaacgacaccgagcacuucaaccagugggucgugccccgcuacgccggggcccugaaccugaacacgaaccucgcgccgagcguggcccccgucuuccccggcgagcggcugcuguucuuccgcuccuacgugccccucaagggcggguacggcaacccggccaucgacugccugcugccccaggagugggugcagcacuucuaccaggaggccgcgcccagcauguccgaggucgcccucgugcgguacaucaaccccgacaccgggcgcgcccuguucgaggccaagcugcaccgggccggcuucaugaccgugagcuccaacaccagcgcgccggucguggugcccgccaacggguacuuccgcuucgacuccugggucaaccaguucuacagccucgcccccaugggcacggggaacggccggcgccgcgugcaguga

SEQ ID NO: 11286 - RNA, 1629 nt, Artificial Sequence
  derived and/or modified sequence opt1 from VP1__Norovirus_and/or_Norovirus-like__AB629946
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguucaccgucuccaucgaccagauguacaccagccucaacgaggugaucuccgugcagugccagaacgggcgcugcacccuggacggcgagcugcgggggacgacccagcuccaggucagcggcaucugcgccuucaagggcgaggugaccgcccacguccacgacaacgaccaccuguacaacgugaccaucacgaaccugaacgggucccccuucgaccccagcgaggacgugcccgccccgcucggcguccccgacuuccaggggcgcguguucggcaucaucucccagcgggacaagcacaacagccccgggcacaacgagccggcgaaccgcggccacgacgccgugguccccaccuacaccgcccaguacacccccaagcugggccagauccagaucgggacguggcagaccgacgaccugaccgugaaccagcccgugaaguucaccccggucggccucaacgacacggagcacuucaaccaguggguggugccccgguacgccggggcccugaaccugaacaccaaccucgcgcccagcgucgcccccguguucccgggcgagcgccugcuguucuuccgguccuacgugccccucaagggcggguacggcaaccccgccaucgacugccugcugccccaggaguggguccagcacuucuaccaggaggccgcgccgagcauguccgagguggcccucgugcgcuacaucaaccccgacaccgggcgggcccuguucgaggccaagcugcaccgcgccggcuucaugaccgucagcuccaacacgagcgcgcccguggugguccccgccaacggguacuuccgguucgacuccugggugaaccaguucuacagccucgccccgaugggcaccgggaacggccgccgccgggugcaguga

SEQ ID NO: 11287 - RNA, 1629 nt, Artificial Sequence
  derived and/or modified sequence opt1 from VP1__Norovirus_and/or_Norovirus-like__KT962983
augaagauggccagcaacgacgccgcgcccuccaccgacggcgccgccgggcuggugccggagagcaacaccgaggucauggcccucgagcccguggccggcgcggcccuggccgcccccgugacggggcagaccaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucacgauguucccccacgugaucaucgacguccggacccucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacgcugcccauccucacccugggcgagcugagcaacucccgguuccccgucagcaucgaccagauguacaccucccccaacgaggugaucagcgugcagugccagaacgggcgcugcacccucgacggcgagcugcaggggacgacccagcugcaggucuccggcaucugcgccuucaagggcgaggugaccgcccaccuccacgacaacgaccaccuguacaacaucaccaucacgaaccugaacgggagccccuucgacccguccgaggacauccccgcgccccucggcgucccggacuuccaggggcggguguucggcaucaucagccagcgcgacaagcacaacucccccgggcacaacgagcccgcgaaccggggccacgacgccgugguccccaccuacaccgcccaguacaccccgaagcugggccagauccagaucgggacguggcagaccgacgaccugaccgugaaccagcccgugaaguucacccccgucggccucaacgacacggagcacuucaaccaguggguggugccccgcuacgccggggcccugaaccugaacaccaaccucgcgccgagcgucgcccccguguuccccggcgagcggcugcuguucuuccgcagcuacaucccccucaagggcggguacggcaacccggccaucgacugccugcugccccaggagugggugcagcacuucuaccaggaggccgcgcccuccaugagcgaggucgcccucgugcgguacaucaaccccgacaccgggcgcgcccuguucgaggccaagcugcaccgggccggcuucaugaccguguccagcaacacguccgcgccggucguggugcccgccaacggguacuuccgcuucgacagcugggucaaccaguucuacucccucgcccccaugggcaccgggaacggccggcgccgcgugcaguga

SEQ ID NO: 11288 - RNA, 1626 nt, Artificial Sequence
  derived and/or modified sequence opt1 from VP1__Norovirus_and/or_Norovirus-like__AB083780
augaagauggccagcaacgacgccgcgcccuccaacgacggcgccgccgggcuggugccggagaucaacaccgaggucauggcccucgagcccguggccggcggggcgaucgccgcgccccugaccggccagacgaacaucaucgaccccuggauccgcaacaacuucgugcaggccccgaacggggaguucaccaucagcccccggaacucccccggcgagauccugcucaacauggagcugggccccgagcugaacccguuccucgcccaccugagccgcauguacaacggguucgccggcgggauggagguccaggugcugauggccggcaacgccuucaccgccgggaaggugaucuucgcggccgucccgccccacuuccccguggagaaccucuccccgccccagaucaccauguucccccacaucaucaucgacgugcggacgcuggagcccguccugcuccccaugcccgacgugcgcaaccaguucuuccacuacaaccaggugaacgagccccggaugcgccuggucgccaugcuguacacgccccuccggagcaacggcuccaccgaggacguguucaccgugagcugccgcguccugacccggccgucccccgacuucgaguucaacuaccuggugccgcccaccguggagagccgcaccaagcccuucacccuccccguccugacgaucggcgagaugaccaacucccgguuccccgcccccaucgacaugcuguacaccagcccgaacgggaacguggugguccagccccagaacggccgcugcacccucgacggggagcugcagggcuccacgcagcuggugcccgccaacgugugcgcguuccggggcaagaucaccgcccgcaucgucgaccaggccgcccaccaguggcacaugcagaucgacaacccgaacgggacccucuucgaccccaccgaggacgugcccgcgccccugggcacgccggacuucaaggccaagaucuucggggucaucagccagcggaacgacuacaacgacggcucccaggggcccgccaaccgcgcccacgacgccguggugcccaccaccagcgccaaguucacccccaagcugggcuccauccucgucggcacgugggagaacaacgacaucgagacccagccgagcaaguucacccccguggggcugcuggagaugaacgacuucaaccaguggucccuccccaacuacagcggcgcgcugacccugaacauggggcucgcccccgccguguucccgacguuccccggcgagcagauccuguucuuccggagcuucaucccccugaagggcgggcacggcaaccccgccaucgacugccuccugccgcaggaguggauccagcacuucuaccaggaguccgcgcccagccagaccuccgucgcccugauccgcuacgugaaccccgacaccgggcggguccucuucgagggcaagcugcaccgccagggguucaucaccaucgccaagagcggcgacgggcccaucguggugccgcccaacggcuacuuccgguucgacuccugggugaaccaguucuacagccuggcccccaugggcaacgggaacggccgccgccggauccaguga

SEQ ID NO: 11289 - RNA, 1626 nt, Artificial Sequence
  derived and/or modified sequence opt1 from VP1__Norovirus_and/or_Norovirus-like__KX987840
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggauggccgaccugcccgugauccagccccgccucugcacccacgcccgguggcccgcgccgguguacggccugcuggucgaccccagccuccccuccaacccccaguggcagaacgggcgcgugcacguggacggcacccugcugggcaccaccccgaucagcggguccugggucagcugcuucgccgccgaggccgccuacgaguaccaguccggcaccggggagguggcgacguucacccucaucgagcaggacggcagcgccuacguccccggggaccgggccgcgccccugggcuacccggacuucuccggccagcuggagaucgaggugcagaccgagaccacgaagcccggggacaagcucaaggugaccaccuucgagaugauccugggccccaccacgaacgucgaccaggcccccuaccaggggcgcguguacgccagcgugaccgccgccgccacccugaaccucgucgacggccgggugcgcgcggugccgcggagcaucuacggguuccaggacgucauccccgaguacaacgacggccugcuggugccccucgcgcccccgaucggccccuuccugcccggggaggugcugcuccgcuuccggaccuacaugcgccagaucgacuccagcgacgccgccgccgaggccaucgacugcgcccugccccaggaguucaucuccugguucgccagcaacgccuucacgguccaguccgaggcccugcuccugcgguaccgcaacacccugaccggccagcuccuguucgagugcaagcuguacagcgagggguacaucgcgcuguccuacccgggcagcgggccccucaccuuccccacggacggcuucuucgaggugguguccugggucccccgccuguaccagcuggccagcgugggcucccucgccaccgggcggacccugaagcaguga

SEQ ID NO: 11290 - RNA, 1626 nt, Artificial Sequence
  derived and/or modified sequence opt1 from VP1__Norovirus_and/or_Norovirus-like__KR349276
augcgcaugagcgacggcgccgcccccaaggcgaacggguccgaggccaacggccaggaccuggugccgaccgccgucgagcaggccgugcccauccagcccguggccggggcgagccucgccgcccccgccgcgggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcacgaacagccccggcgacgaguccuucguggugagcgggcggcugcucuccaagcccgcggccgacuucaacuucgucuaccugacgcccccgaucgagcgcaccaucuaccggaugguggaccugcccgugcuccagccccgccugugcacccacgcccgguggcccgccccggucuacggccugcucguggaccccagccugggguccaacccccaguggcagaacggccgcgugcacgucgacggcacccugcucgggaccacccccaucagcggcuccugggugagccuguucgccgcggaggccgccuacgaguuccaguccgggaccggcgaggucgccacguucacccugaucgagcaggacgggagcgccuacgugccgggcgagcgggcggcgccccucggcuaccccgacuucuccgggcagcuggagaucgaggugcagaccgagaccacgaagaccggcgacaagcugaaggucaccaccuucgagaugauccucgggccgacgaccaacguggaccaggcccccuaccagggccgcguguacgccagccugaccaccgccgccagccuggaccucgucgacgggcgggugcgcgccgugccccgguccaucuacggcuuccaggacgucauccccgaguacaacgacggccugcuggugccgcucgccccgcccaucgggcccuuccugcccggcgaggugcugcuccgcuuccggacguacaugcgccagaucgacagcuccgacgccgcggccgaggccaucgacugcgcccugccccaggaguucgucagcugguucgccuccaacgcguucaccgugcagagcgaggcccugcuccugcgguaccgcaacacccugaccgggcagcuccuguucgagugcaagcuguacuccgagggcuacaucgcccugagcuacuccgggagcggcccccucacguuccccaccgacggcuucuucgagguggucuccugggggccgcgccuguaccagcuggccagcgugggcucccucgccaccgggcggacccugaagcaguga

SEQ ID NO: 11291 - RNA, 1626 nt, Artificial Sequence
  derived and/or modified sequence opt1 from VP1__Norovirus_and/or_Norovirus-like__KM102449
augcgcaugagcgacggcgccgcccccaaggcgaacggguccgaggccaucggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcucccugaccaccgcccagaucacgugcuucccccacgugaugugcgacguccgcgcgcucgagcccauccagcugccccugcucgacgugcggcgcgugcuguggcacgccacccaggaccaggaggagagcaugcggcuggucugcaugcucuacaccccgcugcgcaccaacucccccggcgacgagagcuucgugguguccgggcggcugcucagcaagcccgccgccgacuucaacuucgucuaccugacgcccccgaucgagcgcaccguguaccggaugguggaccugcccguccuccagccccgccugugcacccacgcccgguggcccgcgccgguguacggccugcucguggaccccucccugcccagcaacccccaguggcagaacgggcgcguccacgugaacggcacccugcucggcacgaccccggucuccgggagcuggguguccugcuucgccgccgaggccgccuacgaguuccagagcggcaccggggagguggcgaccuucacgaugaucgagcaggacggcuccgccuacguccccggggaccgggccgcgccccugggcuacccggacuucagcggccagcuggagaucgaggugcagaccgagaccaccaaguccggggacaagcucaaggugacgaccuucgagaugauccugggccccaccaccaacgccgaccaggcccccuaccaggggaaggucuacgccagccuggccgccgcggcgccccucgaccugguggacggccgcgugcgggccgucccgcgcagcguguacuucuuccaggacgugcugcccgaguacaacgacgggcuccuggucccccuggcgcccccgcucggccccuuccugcccggcgaggugcugcuccgguuccgcacguacgugcggcagcuggacaccgccgacgccgccgcccagcccaucgacugcgcccugccgcaggaguucaucuccugguucgccagcaacuccuucaccguccagagcgaggcccuccugauccgcuaccggaacacccugacggggcagcuccuguucgaggccaagcuguacuccgagggcuacaucgccgugagcuacuccgggagcggcccccugaccuuccccaccgacggguucuucgagguggucuccugggugccccgccucuuccagcuggccagcgugggcucccuggcgaccggccgcacgcucaagcaguga

SEQ ID NO: 11292 - RNA, 1626 nt, Artificial Sequence
  derived and/or modified sequence opt1 from VP1__Norovirus_and/or_Norovirus-like__KC792553
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaucggccagguggccaccuucacgaugaucgagcaggacgggagcgcguacgugcccggggaccgggccgcgccccugggcuacccggacuacuccggccagcuggagaucgagguccagaccgagaccaccaaggccggggacaagcucaaggugacgaccuucgagaugauccugggccccaccaccaacgccgaccaggcccccuaccaggggcgcgccuacgccagccugacggccgcggccagccucgaccugguggacggccggguccgcgccgugccccgguccaucuacagcuuccaggacgugcugccggaguacaacgacgggcuccuggucccccuggccccgccccucggccccuuccugcccggcgaggugcugcuccgcuuccggaccuacaugcgccagcuggacaccgccgacgcggccgcccagcccaucgacugcgcccugccccaggaguucguguccugguucgccagcaacuccuucaccguccagagcgacgcgcuccuggugcgguaccgcaacacgcugaccgggcagcuccuguucgaggccaagcuguacuccgagggcuacaucgccgugagcuacuccgggagcggcccgcugaccuuccccgccgacgggaucuucgaggucguguccugggugccccgccucuuccagcuggcgagcgucggcucccuggccaccggccggacgcucaagcaguga

SEQ ID NO: 11293 - RNA, 1626 nt, Artificial Sequence
  derived and/or modified sequence opt1 from VP1__Norovirus_and/or_Norovirus-like__AB809991
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcagggccaggacgcguucaucgacugccuccugccgcaggagugggugaaccacuucuaccaggaggccgcccccagccaggccgacguggcccugauccgguacgucaaccccgacaccggccgcacccucuucgaggcgaagcugcaccgguccggguucaucacggugagccacaccggcgccuacccccugguggucccgcccaacgggcacuuccgcuucgacuccugggugaaccaguucuacagccucgcccccaugggcaccgggaacggccggcgccgcguguga

SEQ ID NO: 11294 - RNA, 1626 nt, Artificial Sequence
  derived and/or modified sequence opt1 from VP1__Norovirus_and/or_Norovirus-like__AB809990
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggccgccgccggguguga

SEQ ID NO: 11295 - RNA, 1626 nt, Artificial Sequence
  derived and/or modified sequence opt1 from VP1__Norovirus_and/or_Norovirus-like__AB809977
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgagcgcaccggggaggccaagaacgccaagggcaucuacaucagcaccacguccgggaaguucacccccaagaucggcagcaucggccugcacuccaucaccgagaacgugcacccgaaccagcagagccgguucacccccgucgggguggcccagaacgagaacacgcccuuccagcagugggugcugccccacuacgccggcgcccucgcgcugaacaccaaccuggccccggccgucgcccccaccuuccccggggagcagcuccuguucuuccgcucccgggugcccugcgugcagggccugcaggggcaggacgcguucaucgacugccuccugccgcaggagugggucaaccacuucuaccaggaggccgcccccagccaggccgacguggcccugauccgcuacgugaaccccgacaccggccggacccucuucgaggcgaagcugcaccgcuccggcuucaucacggucagccacaccggggccuacccccugguggugccgcccaacggccacuuccgguucgacuccugggucaaccaguucuacagccucgcccccauggggaccggcaacgggcgccgccggguguga

SEQ ID NO: 11296 - RNA, 1626 nt, Artificial Sequence
  derived and/or modified sequence opt1 from VP1__Norovirus_and/or_Norovirus-like__AB809987
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucauccaggacaacgucuccgaggggaccggcgaggccaagaacgccaaggggguguacaucagcaccaccuccggcaaguucacgcccaagaucggcagcaucgggcugcacuccaucaccgagaacguccacccgaaccagcagagccgcuucacccccgugggcguggcccagaacgagaacacccccuuccagcaguggguccugccccacuacgccggggcccucgcgcugaacacgaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggccgccgccggguguga

SEQ ID NO: 11297 - RNA, 1626 nt, Artificial Sequence
  derived and/or modified sequence opt1 from VP1__Norovirus_and/or_Norovirus-like__AJ844469
augaugauggccagcaaggacgcccccuccaacauggacggcaccagcggggcgggccagcuggugccggaggccaacaccgccgaccccaucccccucgagcccgucgugggggccgccacggcggccgccaccgccggccaggugaacaugaucgacccguggaucaugaacaacuucguccagucccccgagggggaguucaccaucagccccaacaacacccccggcgacauccuguucgaccugcagcucggcccgcaccugaaccccuuccugcagcaccucucccagauguacaacgggugggugggcaacaugcgcgugcggauccugcuggcggggaacgccuucagcgccggcaagaucaucaucugcugcgucccgcccggguucacggcccagaacaucuccaucgcccaggcgaccauguucccccacgugaucgccgacgugcgcguccucgagcccaucgagaucccccuggacgacgugcggaacgugcuguuccacaccaacgagaacaagcccaccaugcgccuccugugcaugcuguacacgccgcuccgggccggcggcgccagcgccgggaccgaccccuucgucaucgcgggccgcgugcugaccugccccucccccgacuucaacuuccuguuccucgugccgcccagcgucgagcagaagacccggcagcugacggugcccaacaucccccugaacaaccucuccaacagccgcgugccggccaugaucuccaagauggccaucagcuccgacgccaaccaggucgugcaguuccagaacgggcggugcaccaccgacggccagcugcugggcaccacgcccaucagcgccucccagguggcgcgcauccgggggaaggucuucagcaccuccagcggcaaggggcucaaccugagcgagcuggacggcucccccuaccacgccuucgagagccccgccccggugggguuccccgaccucggcuacugcgacuggcacguguccagcuucaaggccgaccacaacuccagcuccgaccccaucagccgccuggacaucaagcagggcgccuccuucgcgccgcaccuggggagcaucgaguacaccaccucccagaaccccgacggcgaccagcucgggacgcugaccuggaucagcucccccagcgacgacacccccggccacgggaccaucaaccuguggaagaucccguccuacggcagcacggucaccgaguccgugcaccucgccccgcccaucuacccgcccggcuucggggagacccuggucuacuucaugagcgacuuccccaucggccacaccaacuccaacauggcccaggugcccugcacgcugccccaggaguucguggcccacuucgucaacgagcaggcgcccgugcgcggggacgccgcccuccugcacuacguggaccccgacacccaccggaaccugggcgaguucaagcucuaccccgagggguacaucacgugcguccccaacaccggcggcgggggcccgcagagccugcccaucaacgggguguucaucuucagcuccugggugagccgguacuaccagcugaagcccgucggcaccgccggccccgcccgccggcucuga

SEQ ID NO: 11298 - RNA, 1626 nt, Artificial Sequence
  derived and/or modified sequence opt1 from VP1__Norovirus_and/or_Norovirus-like__AY675555
augaagauggccagcaaggacgcccccuccaacauggacggcaccagcggggcgggccagcuggugccggaggccaacaccgccgaccccaucccccucgagcccgucgugggggccgccacggcggccgccaccgccggccaggugaacaugaucgacccguggaucaugaacaacuucguccagucccccgagggggaguucaccaucagccccaacaacacccccggcgacauccuguucgaccugcagcucggcccgcaccugaaccccuuccugcagcaccucucccagauguacaacgggugggugggcaacaugcgcgugcggauccugcuggcggggaacgccuucagcgccggcaagaucaucaucugcugcgucccgcccggguucacggcccagaacaucuccaucgcccaggcgaccauguucccccacgugaucgccgacgugcgcguccucgagcccaucgagaucccccuggacgacgugcggaacgugcuguuccacaccaacgagaaccgccccaccaugcggcuccugugcaugcuguacacgccgcuccgcgccggcggcgccagcgccgggaccgaccccuucgucaucgcgggccgggugcugaccugccccucccccgacuucaacuuccuguuccucgugccgcccagcgucgagcagaagacccgccagcugacggugcccaacaucccccugaacaaccucuccaacagcuccgugccggccaugaucaacaagauggccaucagcuccgacgccaaccaggucgugcaguuccagaacgggcggugcaccaccgacggccagcugcugggcaccacgcccaucagcgccucccagguggcgcgcauccgggggaaggucuucagcaccuccagcggcaaggggcucaaccugagcgagcuggacggcucccccuaccacgccuucgagagccccgccccggugggguuccccgaccucggccacugcgacuggcacguguccagcuucaaggccgaccagaacuccagcggcgaccccaucucccgccuggacaucaagcagggggccagcuucgcgccgcaccugggcuccaucgaguacaccaccagccagaaccccgacgggggccagcucgggacgcugaccuggaucuccagccccuccgacgacacccccggccacggcaccaucaaccuguggaagaucccgagcuacggguccacggucaccgagagcgugcaccucgccccgcccaucuacccgcccggcuucggggagacccuggucaaccugauguccaacuuccccaucggccacaccaacagcaacauggcccaggugcccugcacgcucccccaggaguucguggcccacuucgucaacgagcaggcgcccgugcgcggggacgccgcccugcugcacuacguggaccccgacacccaccggaaccucggcgaguucaagcuguaccccgagggcuacaucacgugcguccccaacaccgggggcgggggcccgcagucccugcccaccaacggcguguucaucuucagcagcugggugucccgguacuaccagcucgagcccgucgggaccgccggccccgcccgccggcuguga

SEQ ID NO: 11299 - RNA, 1626 nt, Artificial Sequence
  derived and/or modified sequence opt1 from VP1__Norovirus_and/or_Norovirus-like__EU085479
augaagauggccagcuccgacgccacccccagcaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucuccgccgcgcagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucacgguguccugccgggugcugacccgccccagccccgacuucuccuucaacuuccuggugcccccgaccguggagagcaagaccaagcccuucacgcuccccauccugaccaucuccgagaugagcaacucccgguuccccgugccgaucgacagccugcacaccucccccaccgagaacaucgucgugcagugccagaacgggcgcgugacgcucgacggcgagcugauggggaccacccagcugcuccccagccagaucugcgccuuccggggcguccugacccgcuccacgagccggaccagcgaccaggccgacaccgcgacgccccgccuguucaacuacuacuggcacauccagcucgacaaccugaacggcacgccguacgaccccgccgaggacauccccgggccgcugggcacccccgacuuccgggggaagguguucggcguggccucccagcgcaaccccgacagcaccacccgggcccacgaggccaaggucgacacgaccgcggggcgcuucacccccaagcucggcucccuggagaucagcaccgaguccagcgacuucgaccagaaccagccgacgcgguucacccccgugggcaucggggucgaccacgagaccgacuuccagcaguggucccugcccgacuacagcggccaguucacccacaacaugaaccucgcccccgccguggccccgaacuuccccggggagcagcugcuguucuuccgcucccagcuccccagcuccggcgggcggagcaacggcauccuggacugccuggugccccaggaguggguccagcacuucuaccaggaguccgcgccggcccagacccagguggcccucgugcgcuacgucaaccccgacaccggccgcgugcuguucgaggccaagcugcacaagcucggguucaugaccaucgccaagaacggcgacagccccaucaccgugcccccgaacggguacuuccgguucgaguccugggucaaccccuucuacacgcuggcgcccaugggcagcggguga

SEQ ID NO: 11300 - RNA, 1626 nt, Artificial Sequence
  derived and/or modified sequence opt1 from VP1__Norovirus_and/or_Norovirus-like__AF542090
auggccagcaaggacgcccccguguccggcaccgacggggcggccggccuggucccggagagccagcaggaggugcucccccuggagcccguggccgggguccagcuggccgcccccguggcgggccaguccaacaucaucgacccguggauccgcaugaacuucgugcaggcccccgccggggaguucaccgucagcccccggaacgcccccggcgaggugcucaucgaccuggagcugggcccggagcucaaccccuaccugaaccaccuggcgcgcauguacaacggguacgugggcgggauggaggucgagguggugcucgccggcaacgccuucacggccgggaagguccuguucgccgcggugccgcccuccuuccccacccacggcaucaccgccgcccaggccaccaugcugccccacgugaucgucgacgugcggcagcucgagcccgugcgccugccccugccggacguccggaacgugauguuccacuucugccaggagaacaaggagccccgcaugcggaucguggccauccucuacacgccccugcgcgcgaacggcgccggggacgacgucuucaccgugagcugccgggugcugacccgccccuccccggacuucgacuucaucuuccucgucccgcccagcguggaguccaagcugaagcaguucacccugcccaaccuccagcccaacgagaugacgaacagccgguuccccaccuccgucacccagcuguacaccagccccaacacgaaccugguggugcaguuccagaacggccgcugccagcucgacgggacccugcugggcaccacccccguccgggccgccgacaucugcuccuuccgcggcaucacgagcgccgagguggacaccaccgacuccagccggguggcggggucccaccgcgucauggugcagcucaaggagccggacggcgaggaguucagccccaccgggcccaacccggcccccgugggcacgcccgacuuccaggccgccaucuucgggacccugucccagcggaacaacaccggcggcagcgggcagaacagcaaccgcucccacuucgccuacuucuacacccggaaccccacguucgcgccgggcaucgggaccgucguguucagcuucgacaccaccgacuuccagaaccgccagcccacgaaguucucccccagcggcguguacgacgacgacuccagcgagcccuucaaccaguucucccugccguacuacaacgggagccucggcgccgucgacgccggcaagcuggccccgcccguggcgcccaacuaccccggggagcagauccuguacuuccggggcaacauccccuucaagggcggguacgggggcggcgagaucgacugccuccugccccaggaguggaucacccaccuguacgccgagcaggcccccacccagggggacgccgcccuccugcgcuacuacaacccggacaccggccgcgugcuguucgagugcaagcuccaccgggagggguucaucacgaucaacuacaccggcuccaacgcgcuggccguccccgugaacggcguguuccgcuucgaggggugggucaacaaguucuacacccugacccccauguga

SEQ ID NO: 11301 - RNA, 1623 nt, Artificial Sequence
  derived and/or modified sequence opt1 from VP1__Norovirus_and/or_Norovirus-like__KM386680
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagcccgccccagaucacgauguucccccacgugaucaucgacgugcggacccuggagcccguccugcuccccaugcccgacgugcgcuccacccuguuccacuucaaccagaaggacgagcccaagaugcggcugguggccaugcucuacacgccccugcgcagcaacggguccggcgacgacgucuucaccgugagcugccggauccugacccgcccgucccccgaguucgacuucaccuaccucgugccgcccaccgucgagagcaagacgaagcccuucacccugcccgugcugacccucggcgagcuguccaacagccgguucccccuguccaucgacgagauggugaccagccccaacgaguccaucgucgugcagccgcagaacgggcgcgugacgcucgacggcgagcugcuggggaccacccagcuccaggccugcaacaucugcagcauccggggcaaggucaccggccaggugcccaacgagcagcacauguggaaccuggagaucacgaaccugaacgggacccaguucgaccccaccgacgacgucccggcgccccucggcgugcccgacuucgccggggagguguucggcguccugucccagcgcaaccgcggggagagcaaccccgccaaccgggcccacgacgccgugguggccaccuacagcgacaaguacacgccgaagcugggccucguccagaucggcaccuggaacaccaacgacguggagaaccagcccaccaaguucacgcccaucgggcugaacgagguggcgaacggccaccgguucgagcaguggacccugccccgcuacuccggggcccucacccugaacaugaaccuggccccggccgucgcgccccucuuccccggcgagcggcugcuguucuuccgcagcuacgugccccucaagggcggguucggcaacccggccaucgacugccuggugccccaggaguggguccagcacuucuaccaggaguccgcccccagccugggggacguggcccucgugcgguacgucaaccccgacaccggccgcgugcuguucgaggccaagcugcacaagggcggguuccucacgguguccagcaccuccaccgggccggucguggugcccgcgaacggcuacuuccgguucgacagcugggucaaccaguucuacucccuggcccccaugggcaccgggaacggccgccgccgguuccaguga

SEQ ID NO: 11302 - RNA, 1623 nt, Artificial Sequence
  derived and/or modified sequence opt1 from VP1__Norovirus_and/or_Norovirus-like__AF397156
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcggacccuggagcccguccugcuccccaugccggacgugcgcagcacccuguuccacuucaaccagaaggacgagcccaagaugcggcugguggccaugcucuacacgccccugcgcuccaacgggagcggcgacgacgucuucaccguguccugccggauccugacccgccccagcccggaguucgacuucaccuaccucgugccgcccaccgucgaguccaagacgaagcccuucacccugcccgugcugacccucggcgagcugagcaacucccgguucccccugagcaucgacgagauggugaccucccccaacgagagcaucgucgugcagccccagaacgggcgcgugacgcucgacggcgagcugcuggggaccacccagcuccaggccugcaacaucugcuccauccggggcaaggucaccggccaggugccgaacgagcagcacauguggaaccuggagaucacgaaccugaacgggacccaguucgaccccaccgacgacguccccgccccgcucggcgugcccgacuucgcgggggagguguucggcguccugagccagcgcaaccgcggggagagcaaccccgccaaccgggcccacgacgccgugguggccaccuacuccgacaaguacacgcccaagcugggccucguccagaucggcaccuggaacaccaacgacguggagaaccagccgaccaaguucacgcccaucgggcugaacgagguggcgaacggccaccgguucgagcaguggacccugccccgcuacagcggggcccucacccugaacaugaaccuggcccccgccgucgccccgcuguuccccggcgagcggcuccuguucuuccgcuccuacgugccccucaagggcggguucggcaaccccgcgaucgacugccuggugccgcaggaguggguccagcacuucuaccaggagagcgcccccucccugggggacguggcccucgugcgguacgucaaccccgacaccggccgcgugcuguucgaggccaagcugcacaagggcggguuccucacggugagcuccaccagcaccgggcccgucguggugccggcgaacggcuacuuccgguucgaccccuggggcaaccaguucuacucccuggcccccauggggaccggcaacgggcgccgccgguuccaguga

SEQ ID NO: 11303 - RNA, 1623 nt, Artificial Sequence
  derived and/or modified sequence opt1 from VP1__Norovirus_and/or_Norovirus-like__AF414422
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcggacccuggagcccguccugcuccccaugccggacgugcgcagcacccuguuccacuucaaccagaaggacgagcccaagaugcggcugguggccaugcucuacacgccccugcgcuccaacgggagcggcgacgacgucuucaccguguccugccggauccugacccgccccagcccggaguucgacuucaccuaccucgugccgcccaccgucgaguccaagacgaagcccuucacccugcccgugcugacccucggcgagcugagcaacucccgguucccccugagcaucgacgagauggugaccucccccaacgagagcaucgucgugcagccccagaacgggcgcgugacgcucgacggcgagcugcuggggaccacccagccgcaggccugcaacaucugcuccauccggggcaaggucaccggccaggugcccaacgagcagcacacguggaaccucgagaucaccaaccugaacgggacccaguucgaccccaccgacgacgucccggcgccccugggcgugcccgacuucgccggggagguguucggcguccucagccagcgcaaccgcggggagagcaaccccgccaaccgggcccacgacgccgugguggccacguacuccgacaaguacaccccgaagcugggccugguccagaucggcaccuggaacaccaacgacguggagaaccagcccacgaaguucacccccaucgggcucaacgagguggcgaacggccaccgguucgagcaguggacccugccccgcuacagcggggcccugacccucaacaugaaccuggccccggccgucgcgccccuguuccccggcgagcggcuccuguucuuccgcuccuacgugccccugaagggcggguucggcaacccggccaucgacugccucgugccccaggaguggguccagcacuucuaccaggagagcgcccccucccugggggacguggcccuggugcgguacgucaaccccgacacgggccgcguccucuucgaggccaagcugcacaagggcggguuccugaccgugagcuccaccagcaccgggccggugguggugcccgcgaacggcuacuucggcuucgacuccugggucaaccaguucuacagccucgcccccauggggacgggcaacgggcggcgccgcuuccaguga

SEQ ID NO: 11304 - RNA, 1623 nt, Artificial Sequence
  derived and/or modified sequence opt1 from VP1__Norovirus_and/or_Norovirus-like__AF414423
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagagcggccccgagcugaacccguaccuggcccaccucgcgcgcauguacaacggcuacgccgggggcauggagguccaggugaugcuggccgggaacgccuucaccgccggcaagaucaucuucgcggccgugccgcccuacuuccccgucgagaaccugucccccagccagaucacgauguucccccacgugaucaucgacgugcggacccucgagcccguccugcugcccaugccggacgugcgcuccacccccuuccacuucaaccagaaggacgagcccaagaugcggcucguggccaugcuguacacgccccugcgcagcaacggguccggcgacgacgucuucaccgugagcugccggauccucacccgcccgucccccgaguucgacuucaccuaccuggugccgcccaccgucgagagcaagacgaagcccuucacccugcccgugcucacccugggcgagcuguccaacagccgguucccccucuccaucgacgagauggugaccagccccaacgaguccaucgucgugcagccgcagaacgggcgcgugacgcuggacggcgggcugcucggcaccacccagcugcaggccugcaacaucugcagcauccggggcaaggucaccggccaggugcccagcgagcagcacauguggaaccuggagaucacgaaccucaacgggacccaguucgaccccaccgacgacgucccggcgccccugggggugcccgacuucgccggcgagguguucgggguccugucccagcgcaaccggggcgagagcaacuccgccaaccgcgcccacgacgccgugguggccaccuacagcgacaaguacacgcccaagcucggccugguccagaucgggaccuggaacaccaacgacguggagaaccagccgaccaaguucacgcccaucggccugaacgggguggcgaacggccaccgguucgagcaguggacccucccccgcuacuccggggcccugacccugaacaugaaccucgcccccgccgucgccccgcuguuccccggcgagcggcuccuguucuuccgcagcuacgugccccugaagggcggguucggcaaccccgcgaucgacugccuggugccgcaggaguggguccagcacuucuaccaggaguccgcccccagccucggggacguggcccuggugcgguacgucaaccccgacaccggccgcgugcuguucgaggccaagcuccacaagggcggguuccugacgguguccagcaccuccaccggccccgucguggugccggcgaacggguacuuccgguucgacagcugggucaaccaguucuacucccuggcccccaugggcaccgggaacggccgccgccgguuccaguga

SEQ ID NO: 11305 - RNA, 1623 nt, Artificial Sequence
  derived and/or modified sequence opt1 from VP1__Norovirus_and/or_Norovirus-like__GQ856476
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucucccgcauguacaacggcuacgccgggggcguggagguccaggugcugcuggccgggaacgccuucaccgccggcaagcucguguucgcggccaucccgccccacuuccccgucgacaaccugagccccgggcagaucaccauguucccccacgugaucaucgacgugcggacccuggagcccguccuccugccccugccggacgugcgcaacaacuucuuccacuacaaccagcaguccgaccagcggaugcgccucguggccaugcuguacacgccccugcggagcaacggcuccggcgacgacgucuucaccgugagcugccgcgugcucacccggcccucccccgacuucgacuucaacuaccuggucccgcccaccguggagagcaagacgaagcccuucuccgugcccguccugacccucaacgagcugaccaacagccgcuucccggugcccaucgacgccauguacaccucccccaacgacagcaucgugguccagccccagaacgggcgggccacgaucgacggcgagcugcucgggaccacccagcugaucccguccggcaucugcagcuuccgcggcaagaucaccacgcaccuggcggacgaccggcaccucuggaacauccagguguccaaccugaacgggacccccuucgaccccaccgacgacgucccggcgccccugggcaugcccgacuucagcgggcagaucuucggcguggugagccagcgcgacaccgggacgaaccccgccaaccgggcccacgacgccguccucgccaccuacuccgccaaguacaccccgaagcugggcagcgugcagaucggcaccugggacacggaggaccugcucgagcgccagcccgugaaguucacccccgucgggcugaacgagaucggccaggacaagcacuucgaccagugggugcugcccaacuacuccggggcccucggccugaacaugcaccuggccccggccgugagcccccucuuccccggggagcggcugcuguucuuccgcuccuacaucccccucaagggcggccacggggacccguucaucgacugccuggucccccaggaguggauccagcacuucuaccaggagagcgcgcccgcccaguccagcguggcccugcuccgguacgugaaccccgacaccggccgcacccuguucgaggccaagcugcacaagggcggguucaucacggucuccagcaccgagaaccggccggugaucgugccgcccaacggguacuuccgcuucgacuccugggucaaccaguucuacagccuggcgcccaugggcaccggcaacgggcgccggcgcaugcaguga

SEQ ID NO: 11306 - RNA, 1623 nt, Artificial Sequence
  derived and/or modified sequence opt1 from VP1__Norovirus_and/or_Norovirus-like__AJ277607
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagccccaagaacucccccggggagauccuggugaaccucgagcugggccccgagcugaacccguaccucgcccaccuggcgcggauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcgcacccuggagcccguccugcuccccaugccggacgugcggagcacccuguuccacuucaaccagaaggacgagcccaagaugcgccugguggccaugcucuacacgccccugcgguccaacgggagcggcgacgacgucuucaccguguccugccgcauccugacccggcccagcccggaguucgacuucaccuaccucgugccgcccaccgucgaguccaagacgaagcccuucacccugcccgugcugacccucggcgagcugagcaacucccgcuucccccugagcaucgacgagauggugaccucccccaacgagagcaucgucgugcagccccagaacgggcgggugacgcucuacggcgagcugcuggggaccgcccagcuccaggccugcaacaucugcuccauccgcggcaaggucaccggccaguucccgaacgagcagaacauguggaaccuggagaucaccaaccugaacgggacgcaguucgaccucaccgacgacgugcccgcgccccugggcgucccggacuucgccggggagguguucggcgugcugagccagcggaaccgcggggagagcaaccccgccaaccgggcccacgacgccgucguggcgaccuacuccgacaaguacacccccaagcucggccuggugcagaucggcacguggaacaccaacgacgucgagaaccagcccaccaaguucaccccgaucgggcugaacgagguggccaacggccaccgcuucgagcaguggacgcucccccgguacagcggggcccugacccugaacaugaaccucgcccccgccguggcgccccuguucccgggcgagcgccuccuguucuuccgguccuacgucccccugaagggcggguucggcaaccccgccaucgacugccuggugccccaggagugggugcagcacuucuaccaggagagcgccccgucccucggggacgucgcccuggugcgcuacgugaaccccgacaccggccggguccuguucgaggcgaagcuccacaagggcggguuccugaccgugagcuccacgagcaccgggcccguggucgugcccgccaacggcuacuuccgcuucgacuccugggugaaccaguucuacagccuggccccgaugggcaccgggaacggccggcgccgcuuccaguga

SEQ ID NO: 11307 - RNA, 1623 nt, Artificial Sequence
  derived and/or modified sequence opt1 from VP1__Norovirus_and/or_Norovirus-like__AY772730
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucgcccgcauguacaacggcuacgccgggggcguggagguccaggugcugcuggccggguccgccuucaccgcgggcaagcucguguucgccgccaucccgccccacuuccccgucgacaaccugagccccgggcagaucaccauguucccccacgugaucaucgacgugcggacccuggagcccguccuccugccccugccggacgugcgcaacaacuucuuccacuacaaccagcaguccgaccagcggaugcgccucguggccaugcuguacacgccccugcggagcaacggcuccggcgacgacgucuucaccgugagcugccgcgugcucacccggcccucccccgacuucgacuucaacuaccuggucccgcccaccguggagagcaagacgaagcccuucuccgugcccguccugacccucaacgagcugaccaacagccgcuucccggugcccaucgacgccauguacaccucccccaacgacagcaucgugguccagccccagaacgggcgggcgacgaucgacggcgagcugcucgggaccacccagcugaucccguccggcaucugcagcuuccgcggcaagaucaccacgcaccuguccgacgaccggcaccucuggaacauccaggugagcaaccugaacgggacccccuucgaccccaccgacgacgucccggcgccccugggcaugcccgacuucagcgggcagaucuucggcguggugucccagcgcgacaccgggacgaaccccgccaaccgggcccacgacgccgcccucgccaccuacagcgccaaguacaccccgaagcugggcuccguccagaucggcgccugggacaccgaggaccugcucgagcgccagcccgugaaguucagccccguggggcuguccgagaucggccaggacaagcacuucgaccaguggguccugcccaacuacagcggggcccucggccugaacgugcaccuggcgccggccgugagcccccucuuccccggggagcggcugcuguucuuccgcuccuacaucccccucaagggcggccacggggacccguucaucgacugccuggucccccaggaguggauccagcacuucuaccaggaguccgcccccgcccagagcuccguggcgcugcuccgguacgugaaccccgacacgggccgcacccuguucgaggccaagcugcacaaggagggguucaucaccgucagcuccaccgagaaccggccggugaucgugccgcccaacggcuacuuccgcuucgacagcugggucaaccaguucuacucccuggcccccauggggacgggcaacggccgccggcgcaugcaguga

SEQ ID NO: 11308 - RNA, 1623 nt, Artificial Sequence
  derived and/or modified sequence opt1 from VP1__Norovirus_and/or_Norovirus-like__KT315718
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccgacagcacccgggcccagcaggcguccgugagcacguacagcccccaguucgugccgaagcugggcuccgucaaccuccgcaucagcaacaacgacgacuuccaguuccagcccaccaaguucacccccgugggcgugaacgacgacgacgacgggcaccccuuccggcagugggagcugccgaacuacuccggcgagcugacccucaacaugaaccuggccccgcccgucgcccccaacuuccccggggagcagcuccuguucuuccgcagcuucgugcccugcuccggcggguacaaccagggcaucaucgacugccugaucccccaggaguggauccagcacuucuaccaggagagcgcccccucccagagcgacguggcccugauccgguacgucaacccggacacgggccgcacccucuucgaggcgaagcugcaccgcuccggguacaucaccguggcccacagcggcgacuacccccuggugguccccgccaacgggcacuuccgguucgacuccugggugaaccaguucuacagccucgcccccaugggcaccgggaacggccgccggcgcgcgcaguga

SEQ ID NO: 11309 - RNA, 1623 nt, Artificial Sequence
  derived and/or modified sequence opt1 from VP1__Norovirus_and/or_Norovirus-like__KT315708
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggcuacuuccgguucgacuccugggugaaccaguucuacagccucgcccccauggggaccggcaacggccgccggcgcgcgcaguga

SEQ ID NO: 11310 - RNA, 1623 nt, Artificial Sequence
  derived and/or modified sequence opt1 from VP1__Norovirus_and/or_Norovirus-like__KT315697
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccucuucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcgcgcuguucgaggccaagcugcaccgcuccggcuacaucaccguggcccacagcggggacuacccccuggugguccccgccaacggccacuuccgguucgacuccugggugaaccaguucuacagccucgcgcccauggggaccggcaacggccgccggcgcgcccaguga

SEQ ID NO: 11311 - RNA, 1623 nt, Artificial Sequence
  derived and/or modified sequence opt1 from VP1__Norovirus_and/or_Norovirus-like__KT315689
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccgugagccacuccggggacuacccccuggugguccccgccaacggccacuuccgguucgacagcugggugaaccaguucuacucccucgcccccauggggaccggcaacggccgccggcgcgcccaguga

SEQ ID NO: 11312 - RNA, 1623 nt, Artificial Sequence
  derived and/or modified sequence opt1 from VP1__Norovirus_and/or_Norovirus-like__KX216805
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccgaccggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugucccagcgcaacgucgggaacgacgcccccggcagcacgcgggcccagcaggcguggguguccaccuacagcccccaguucgugccgaagcugggcagcgucaaccuccgcaucuccgacaacgacgacuuccaguuccagcccaccaaguucacccccgugggggugaacgacgacgacgacggccaccccuuccggcagugggagcugccgaacuacagcggggagcugacgcucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacaccgggcgcacccucuucgaggcgaagcugcaccgcagcggcuacaucaccguggcccacuccggggacuacccccuggugguccccgccaacggcuacuuccgguucgacagcugggugaaccaguucuacucccucgcccccauggggacgggcaacggccgccggcgcgcgcaguga

SEQ ID NO: 11313 - RNA, 1623 nt, Artificial Sequence
  derived and/or modified sequence opt1 from VP1__Norovirus_and/or_Norovirus-like__KU557859
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcgugaucgacugccugaucccccaggaguggauccagcacuucuaccaggagagcgcccccucccagagcgacgucgcccugauccgguacgugaacccggacacggggcgcacccucuucgaggcgaagcugcaccgcuccggcuacaucaccguggcccacagcggggacuacccccuggucgugcccgccaacggccacuuccgguucgacuccugggugaaccaguucuacagccucgcccccauggggaccggcaacggccgccggcgcgcgcaguga

SEQ ID NO: 11314 - RNA, 1623 nt, Artificial Sequence
  derived and/or modified sequence opt1 from VP1__Norovirus_and/or_Norovirus-like__KU557828
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccgacuccacccgggcccagcaggcgugggugagcacguacagcccccaguucgugccgaagcugggcuccgucaaccuccgcaucagcgacaacgacgacuuccaguuccagcccaccaaguucacccccgugggcgugaacgacgacgacgacgggcaccccuuccggcagugggagcugccgaacuacuccggcgagcugacccucaacaugaaccuggccccgcccgucgcccccaacuuccccggggagcagcuccuguucuuccgcagcuucgugcccugcuccggcggguacaaccagggcaucaucgacugccugaucccccaggaguggauccagcacuucuaccaggagagcgcccccucccagagcgacguggcccugauccgguacgucaacccggacacgggccgcacccucuucgaggcgaagcugcaccgcuccggguacaucaccguggcccacagcggcgacuacccccuggugguccccgccaacgggcacuuccgguucgacuccugggugaaccaguucuacagccucgcccccaugggcaccgggaacggccgccggcgcgcgcaguga

SEQ ID NO: 11315 - RNA, 1623 nt, Artificial Sequence
  derived and/or modified sequence opt1 from VP1__Norovirus_and/or_Norovirus-like__KT315692
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucagccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggaccggcaacggccgccggcgcgcgcaguga

SEQ ID NO: 11316 - RNA, 1623 nt, Artificial Sequence
  derived and/or modified sequence opt1 from VP1__Norovirus_and/or_Norovirus-like__KX168437
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgaggugcugcucaaccuggagcugggcccggaccucaaccccuaccuggcgcaccugagccgcauguacaacggguacgccggcgggguggagguccaggugcuccuggccggcaacgccuucaccgccgggaagauccuguucgcggccgugccgcccaacuuccccgucgaguuccucucccccgcccagaucaccaugcugccccaccugaucguggacgugcggacgcucgagcccaucaugaucccgcugcccgacguccgcaacaccuucuuccacuacagcaaccagcccaacucccggaugcgccugguggccaugcucuacacgccccugcggagcaacggcuccggcgacgacguguucaccgucagcugccgcgugcugacccggccgacccccgacuucgaguucaccuaccucgugccgcccuccgucgagagcaagaccaagcccuucucccugcccauccugacgcucagcgagcugaccaacucccgcuuccccgugcccaucgacagccuguucaccgcccagaacaacgugcuccagguccagugccagaacgggcggugcacccuggacggcgagcugcaggggacgacccagcuccugccguccggcaucugcgcguuccgcggccgggugaccgcccagaucaaccagcgcgaccgguggcacaugcagcugcagaaccucaacgggaccacguacgaccccaccgacgacgugcccgccccgcugggcacccccgacuucaagggggucguguucggcauggucagccagcgcaacguggggaacgacgcccccggcuccacccgggcccagcaggcgugggugagcacguacagcccccaguucgucccgaagcugggcuccgugaaccuccgcaucagcgacaacgacgacuuccaguuccagcccaccaaguucacccccgugggggucaacgacgacgacgacggccaccccuuccggcagugggagcugccgaacuacuccggggagcugacccucaacaugaaccuggccccgcccguggcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacgucgcccugauccgguacgugaacccggacacggggcgcacccucuucgaggcgaagcugcaccgcuccggcuacaucaccguggcccacagcggggacuacccccuggucgugcccgccaacggccacuuccgguucgacuccugggugaaccaguucuacagccucgcccccauggggaccggcaacggccgccggcgcgcgcaguga

SEQ ID NO: 11317 - RNA, 1623 nt, Artificial Sequence
  derived and/or modified sequence opt1 from VP1__Norovirus_and/or_Norovirus-like__KX168440
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucggguccgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggagugggugcagcacuucuaccaggaguccgcccccagccaguccgacgucgcccugauccgguacgugaacccggacacggggcgcacccucuucgaggcgaagcugcaccgcagcggcuacaucaccguggcccacuccggggacuacccccuggucgugcccgccaacggccacuuccgguucgacagcugggugaaccaguucuacucccucgcccccauggggaccggcaacggccgccggcgcgcgcaguga

SEQ ID NO: 11318 - RNA, 1623 nt, Artificial Sequence
  derived and/or modified sequence opt1 from VP1__Norovirus_and/or_Norovirus-like__KX216793
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcucgucccguccggcaucugcgcguuccgcggccgggugaccgcccagaucaaccagcgcgaccgguggcacaugcagcugcagaaccugaacgggaccacguacgaccccaccgacgacgugcccgccccgcucggcacccccgacuucaagggggucguguucggcauggucagccagcgcaacguggggaacgacgcccccggcuccacccgggcccagcaggcgugggugagcacguacagcccccaguucgucccgaagcugggcuccgugaaccugcgcaucagcgacaacgacgacuuccaguuccagcccaccaaguucacccccgugggggucaacgacgacgacgacggccaccccuuccggcagugggagcucccgaacuacuccggggagcugacccugaacaugaaccucgccccgcccguggcccccaacuuccccggcgagcagcugcuguucuuccgcagcuucgugcccugcuccgggggcuacaaccagggcaucaucgacugccucaucccccaggaguggauccagcacuucuaccaggagagcgcccccucccagagcgacgucgcccugauccgguacgugaacccggacacggggcgcacccuguucgaggcgaagcuccaccgcuccggcuacaucaccguggcccacagcggggacuacccccuggucgugcccgccaacggccacuuccgguucgacuccugggugaaccaguucuacagccuggcccccauggggaccggcaacggccgccggcgcgcgcaguga

SEQ ID NO: 11319 - RNA, 1623 nt, Artificial Sequence
  derived and/or modified sequence opt1 from VP1__Norovirus_and/or_Norovirus-like__KU557881
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagccuggugcccugcuccgggggcuacaaccagggcaucaucgacugccugaucccccaggaguggauccagcacuucuaccaggagagcgcccccucccagagcgacguggcccucauccgguacgucaacccggacacggggcgcacccuguucgaggcgaagcugcaccgcuccggcuacaucaccguggcccacagcggggacuacccccucgugguccccgccaacggccacuuccgguucgacuccugggugaaccaguucuacagccuggcccccauggggaccggcaacggccgccggcgcgcgcaguga

SEQ ID NO: 11320 - RNA, 1623 nt, Artificial Sequence
  derived and/or modified sequence opt1 from VP1__Norovirus_and/or_Norovirus-like__KY424350
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacaaccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcguggguguccacguacagcccccaguucgugccgaagcugggcagcaucaaccuccgcaucuccgacaacgacgacuuccaguuccagcccaccaaguucacccccgucggggugaacgacgacgacgacggccaccccuuccggcagugggagcugccgaacuacagcggggagcugacccucaacaugaaccuggccccgcccguggcccccaacuuccccggcgagcagcuccuguucuuccgcuccuucguccccugcagcgggggcuacaaccagggcaucaucgacugccugaucccccaggaguggauccagcacuucuaccaggaguccgcccccagccaguccgacguggcccugauccgguacgugaacccggacacggggcgcacccucuucgaggcgaagcugcaccgcagcggcuacaucaccgucgcccacuccggggacuacccccugguggugcccgccaacggccacuuccgguucgacagcugggucaaccaguucuacucccucgcccccauggggaccggcaacggccgccggcgcgcgcaguga

SEQ ID NO: 11321 - RNA, 1623 nt, Artificial Sequence
  derived and/or modified sequence opt1 from VP1__Norovirus_and/or_Norovirus-like__KU557884
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacgcggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacggggccaccuacgaccccacggacgacgugcccgccccgcugggcacccccgacuucaaggggguggucuucggcauggugagccagcgcaacgucggguccgacgcccccggcagcacccgggcgcagcaggccugggugagcaccuacagcccccaguucgugccgaagcugggcuccgucaaccuccgcaucuccgacaacgacgacuuccaguuccagcccacgaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcgcugauccgguacgucaacccggacaccgggcgcacccucuucgaggccaagcugcaccgcagcggcuacaucaccguggcccacuccggggacuacccccuggugguccccgccaacggccacuuccgguucgacagcugggugaaccaguucuacucccucgcgcccauggggaccggcaacggccgccggcgcgcccaguga

SEQ ID NO: 11322 - RNA, 1623 nt, Artificial Sequence
  derived and/or modified sequence opt1 from VP1__Norovirus_and/or_Norovirus-like__KU561253
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccacaccuuccggcagugggagcugcccaacuacuccggggagcugacgcucaacaugaaccuggccccgcccgucgcccccaacuuccccggcgagcagcuccuguucuuccgcagcuucgugccgugcuccgggggcuacaaccagggcaucaucgacugccugaucccccaggaguggauccagcacuucuaccaggagagcgcccccucccagagcgacguggcccugauccgguacgucaaccccgacaccgggcgcacccucuucgaggcgaagcugcaccgcuccggcuacaucaccguggcccacagcggggacuacccgcuggugguccccgccaacggccacuuccgguucgacuccugggugaaccaguucuacagccucgcccccauggggacgggcaacggccgccggcgcgcgcaguga

SEQ ID NO: 11323 - RNA, 1623 nt, Artificial Sequence
  derived and/or modified sequence opt1 from VP1__Norovirus_and/or_Norovirus-like__KP902588
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucggguccgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccagcgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgacuccugggugaaccaguucuacagccucgcccccauggggaccggcaacggccgccggcgcgcgcaguga

SEQ ID NO: 11324 - RNA, 1623 nt, Artificial Sequence
  derived and/or modified sequence opt1 from VP1__Norovirus_and/or_Norovirus-like__KX168456
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucggguccgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacggcgggcaccccuuccggcagugggagcugccgaacuacagcggcgagcugacccucaacaugaaccuggccccgcccgucgcccccaacuuccccggggagcagcuccuguucuuccgcuccuucgugcccugcagcggcggcuacaaccaggggaucaucgacugccugaucccccaggaguggauccagcacuucuaccaggaguccgcccccagccaguccgacguggcccugauccgguacgucaacccggacacgggccgcacccucuucgaggcgaagcugcaccgcagcggguacaucaccguggcccacuccggcgacuacccccuggugguccccgccaacgggcacuuccgguucgacagcugggugaaccaguucuacucccucgcccccaugggcaccggcaacgggcgccggcgcgcgcaguga

SEQ ID NO: 11325 - RNA, 1623 nt, Artificial Sequence
  derived and/or modified sequence opt1 from VP1__Norovirus_and/or_Norovirus-like__KX168444
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcucccccagccaguccgacguggcccugauccgguacgucaacccggacacggggcgcacccucuucgaggccaagcugcaccgcagcggcuacaucaccguggcgcacuccggggacuacccccuggugguccccgccaacggccacuuccgguucgacagcugggugaaccaguucuacucccucgcccccauggggaccggcaacggccgccggcgcgcccaguga

SEQ ID NO: 11326 - RNA, 1623 nt, Artificial Sequence
  derived and/or modified sequence opt1 from VP1__Norovirus_and/or_Norovirus-like__KX216806
augaagauggccaccaacgacgccgcgcccagcaacgacggcgccgccgggcuggugccggagggcaacaacgagacccucccccuggagcccgucgccggggccgcgaucgccgcccccgugacgggccagaacaacaucaucgacccguggauccgcaccaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucacgaugcugccccaccugaucgucgacgugcggacccucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagacgaagcccuucagccugcccauccugacccucuccgagcugaccaacagccgcuuccccguccccaucgacucccuguucaccgcccagaacaacgugcuccaggugcagugccagaacgggcggugcacgcuggacggcgagcugcaggggaccacccagcuccugccgagcggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugucccagcgcaacgucgggaacgacgcccccggcagcacgcgggcccagcaggcguggguguccaccuacagcccccaguucgugccgaagcugggcagcgucaaccuccgcaucuccgacaacgacgacuuccaguuccagcccaccaaguucacccccgugggggugaacgacgacgacgacggccaccccuuccggcagugggagcugccgaacuacagcggggagcugacgcucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacaccgggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggacgggcaacggccgccggcgcgcgcaguga

SEQ ID NO: 11327 - RNA, 1623 nt, Artificial Sequence
  derived and/or modified sequence opt1 from VP1__Norovirus_and/or_Norovirus-like__KX216794
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucugcgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcguggguguccacguacagcccccaguucgugccgaagcugggcagcgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggaccggcaacggccgccggcgcgcgcaguga

SEQ ID NO: 11328 - RNA, 1623 nt, Artificial Sequence
  derived and/or modified sequence opt1 from VP1__Norovirus_and/or_Norovirus-like__KX420895
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgcgcuccaggugcagugccagaacgggcggugcacccuggacggcgagcugcaggggacgacccagcuccugccguccggcaucugcgccuuccgcggccgggugaccgcccagaucaaccagcgcgaccgguggcacaugcagcugcagaaccucaacgggaccacguacgaccccaccgacgacguccccgccccgcugggcacccccgacuucaagggggugguguucggcauggucagccagcgcaacguggggaacgacgcccccggcuccacccgggcgcagcaggccugggucagcacguacagcccccaguucgugccgaagcugggcuccgugaaccuccgcaucagcgacaacgacgacuuccaguuccagcccaccaaguucacccccgucggggugaacgacgacgacgacggccaccccuuccggcagugggagcugccgaacuacuccggggagcugacccucaacaugaaccuggccccgcccguggcccccagcuuccccggcgagcagcuccuguucuuccgcuccuucguccccugcagcgggggcuacaaccagggcaucaucgacugccugaucccccaggaguggauccagcacuucuaccaggaguccgcccccagccaguccgacguggcgcugauccgguacgugaacccggacacggggcgcacccucuucgaggccaagcugcaccgcagcggcuacaucaccgucgcccacuccggggacuacccccugguggugcccgccaacggccacuuccgguucgacagcugggucaaccaguucuacucccucgcgcccauggggaccggcaacggccgccggcgcgcccaguga

SEQ ID NO: 11329 - RNA, 1623 nt, Artificial Sequence
  derived and/or modified sequence opt1 from VP1__Norovirus_and/or_Norovirus-like__KT591501
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggagauccaggugcuccuggccggcaacgccuucaccgccgggaagauccuguucgcggccgucccgcccaacuuccccguggaguuccucucccccgcccagaucaccaugcugccccaccugaucguggacguccggacgcucgagcccaucaugaucccgcugcccgacgugcgcaacaccuucuuccacuacagcaaccagcccaacucccggaugcgccugguggccaugcucuacacgccccugcggagcaacggcuccggcgacgacgucuucaccgugagcugccgcgugcugacccggccgacccccgacuucgaguucaccuaccucgucccgcccuccguggagagcaagaccaagcccuucucccugcccauccugacgcucagcgagcugaccaacucccgcuuccccgugcccaucgacagccuguucaccgcccagaacaacguccuccaggugcagugccagaacgggcggugcacccuggacggcgagcugcaggggacgacccagcuccugccguccggcaucugcgcguuccgcggccgggugaccgcccagaucaaccagcgcgaccgguggcacaugcagcugcagaaccucaacgggaccacguacgaccccaccgacgacguccccgccccgcugggcacccccgacuucaagggggugguguucggcauggucagccagcgcaacgugggguccgacgcccccggcagcacccgggcccagcaggcgugggucagcacguacagcccccaguucgugccgaagcugggcuccgugaaccuccgcaucuccgacaacgacgacuuccaguuccagcccaccaaguucacccccgucggggugaacgacgacgacgacggccaccccuuccggcagugggagcugccgaacuacagcggggagcugacccucaacaugaaccuggccccgcccguggcccccaacuuccccggcgagcagcuccuguucuuccgcuccuucguccccugcagcgggggcuacaaccagggcaucaucgacugccugaucccccaggaguggauccagcacuucuaccaggaguccgcccccagccaguccgacguggcccugauccgguacgugaacccggacacggggcgcacccucuucgaggcgaagcugcaccgcagcggcuacaucaccgucgcccacuccggggacuacccccugguggugcccgccaacggccacuuccgguucgacagcugggucaaccaguucuacucccucgcccccauggggaccggcaacggccgccggcgcgcgcaguga

SEQ ID NO: 11330 - RNA, 1623 nt, Artificial Sequence
  derived and/or modified sequence opt1 from VP1__Norovirus_and/or_Norovirus-like__KT315714
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucggguccgacgcccccggcagcacccgggcccagcaggcguggaucagcacguacagcccccaguucgugccgaagcugggcuccgugaaccuccgcaucuccgacaacgacgacuuccaguuccagcccaccaaguucacccccgucggggugaacgacgacgacgacggccaccccuuccggcagugggagcugccgaacuacagcggggagcugacccucaacaugaaccuggccccgcccguggcccccaacuuccccggcgagcagcuccuguucuuccgcuccuucguccccugcagcgggggcuacaaccagggcaucaucgacugccugaucccccaggaguggauccagcacuucuaccaggaguccgcccccagccaguccgacguggcccugauccgguacgugaacccggacacggggcgcacccucuucgaggcgaagcugcaccgcagcggcuacaucaccgucgcccacuccggggacuacccccugguggugcccgccaacggccacuuccgguucgacagcugggucaaccaguucuacucccucgcccccauggggaccggcaacggccgccggcgcgcgcaguga

SEQ ID NO: 11331 - RNA, 1623 nt, Artificial Sequence
  derived and/or modified sequence opt1 from VP1__Norovirus_and/or_Norovirus-like__KT315673
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagccccaagaacucccccggcgagauccugcucaaccuggagcugggcccggaccucaaccccuaccuggcgcaccugagccggauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcgcacgcucgagcccaucaugaucccgcugcccgacgugcggaacaccuucuuccacuacagcaaccagcccaacucccgcaugcggcuggucgccaugcucuacacgccccugcgcagcaacggcuccggcgacgacguguucaccgugagcugccggguccugacccgcccgacccccgacuucgaguucaccuaccucgugccgcccuccguggagagcaagaccaagcccuucucccugcccauccugacgcucagcgagcugaccaacucccgguuccccguccccaucgacagccuguucaccgcccagaacaacgugcuccaggugcagugccagaacgggcgcugcacccuggacggcgagcugcaggggacgacccagcuccugccguccggcaucugcgcguuccggggccgcgucaccgcccagaucaaccagcgggaccgcuggcacaugcagcugcagaaccucaacgggaccacguacgaccccaccgacgacgugcccgccccgcugggcacccccgacuucaaggggguggucuucggcauggugagccagcggaacgucgggaacgacgcccccggcuccacccgcgcccagcaggcgugggugagcacguacagcccccaguucgugccgaagcugggcuccgucaaccuccggaucagcgacaacgacgacuuccaguuccagcccaccaaguucacccccgugggggugaacgacgacgacgacggccaccccuuccgccagugggagcugccgaacuacuccggggagcugacccucaacaugaaccuggccccgcccgucgcccccaacuuccccggcgagcagcuccuguucuuccggagcuucgugcccugcuccgggggcuacaaccagggcaucaucgacugccugaucccccaggaguggauccagcacuucuaccaggagagcgcccccucccagagcgacguggcccugauccgcuacgucaacccggacacggggcggacccucuucgaggcgaagcugcaccgcuccggcuacaucaccguggcccacagcggggacuacccccuggugguccccgccaacggccacuuccgcuucgacuccugggugaaccaguucuacagccucgcccccauggggaccggcaacggccggcgccgggcgcaguga

SEQ ID NO: 11332 - RNA, 1623 nt, Artificial Sequence
  derived and/or modified sequence opt1 from VP1__Norovirus_and/or_Norovirus-like__KX216792
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcacaacucccggaugcgccuggucgccaugcucuacacgccccugcggagcaacggcuccggcgacgacguguucaccgugagcugccgcguccugacccggcccaccccggacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugcccuccggcaucugcgcguuccgcggccgggucaccgcccagaucaaccagcgcgaccgguggcacaugcagcugcagaaccucaacgggaccacguacgacccgaccgacgacgugcccgcgccccugggcaccccggacuucaaggggguggucuucggcauggugagccagcgcaacgucgggaacgacgcccccggcuccacccgggcccagcaggccugggugagcacguacagcccccaguucgugcccaagcugggcuccgucaacuuccgcaucagcgacaacgacgacuuccaguuccagccgaccaaguucacccccgugggggugaacgacgacgacgacggccaccccuuccggcagugggagcuccccaacuacuccggggagcugacccugaacaugaaccucgccccgcccgucgcccccaacuuccccggcgagcagcugcuguucuuccgcagcuucgugccgugcuccgggggcuacaaccagggcaucaucgacugccucaucccccaggaguggauccagcacuucuaccaggagagcgcccccucccagagcgacguggcccugauccgguacgucaaccccgacacggggcgcacccuguucgaggcgaagcuccaccgcuccggcuacaucaccguggcccacagcggggacuacccgcuggugguccccgccaacggccacuuccgguucgacuccugggugaaccaguucuacagccuggcccccauggggaccggcaacggccgccggcgcgcgcaguga

SEQ ID NO: 11333 - RNA, 1623 nt, Artificial Sequence
  derived and/or modified sequence opt1 from VP1__Norovirus_and/or_Norovirus-like__KU953398
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaccgacgcccccggcuccacgcgggcccagcaggcgugggugagcaccuacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacgcucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacaccgggcgcacccucuucgaggcgaagcugcaccgcuccggcuacaucaccguggcccacagcggggacuacccccuggugguccccgccaacggccacuuccgguucgacuccugggugaaccaguucuacagccucgcccccauggggacgggcaacggccgccggcgcgcgcaguga

SEQ ID NO: 11334 - RNA, 1623 nt, Artificial Sequence
  derived and/or modified sequence opt1 from VP1__Norovirus_and/or_Norovirus-like__KU557888
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacgcggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcagggguccacgcagcuccugccgagcggcaucugcgcguuccgcggccgggucaccgcccagaucaaccagcgcgaccgguggcacaugcagcugcagaaccucaacgggaccaccuacgaccccacggacgacgugcccgccccgcugggcacccccgacuucaaggggguggucuucggcauggugucccagcgcaacgucgggaacgacgcccccggcagcacccgggcccagcaggcgugggugagcaccuacagcccccaguucgugccgaagcugggcuccgucaaccuccgcaucuccgacaacgacgacuuccaguuccagcccacgaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacaccgggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggaccggcaacggccgccggcgcgcgcaguga

SEQ ID NO: 11335 - RNA, 1623 nt, Artificial Sequence
  derived and/or modified sequence opt1 from VP1__Norovirus_and/or_Norovirus-like__KU557808
augaagauggccagcaacgacguggcccccuccaacgacggcgcggccgggcuggucccggagggcaacaacgagacccucccccuggagcccguggccggggccgccaucgcggcccccgugaccggccagaacaacaucaucgacccguggauccgcacgaacuucguccaggcccccaacggggaguucaccgugagcccccggaacucccccggcgagauccugcucaaccuggagcugggcccggaccucaaccccuaccuggcccaccugagccgcauguacaacggguacgcgggcgggguggagguccaggugcuccuggccggcaacgccuucaccgccgggaagauccuguucgccgcggugccgcccaacuuccccgucgaguuccucucccccgcccagaucaccaugcugccccaccugaucguggacgugcggacgcucgagcccaucaugaucccgcugcccgacguccgcaacaccuucuuccacuacagcaaccagcccaacucccggaugcgccugguggccaugcucuacacgccccugcggagcaacggcuccggcgacgacguguucaccgucagcugccgcgugcugacccggccgacccccgacuucgaguucaccuaccucgugccgcccuccgucgagagcaagaccaagcccuucucccugcccauccugacgcucagcgagcugaccaacucccgcuuccccgugcccaucgacagccuguucaccgcccagaacaacgugcuccagguccagugccagaacgggcggugcacccuggacggcgagcugcaggggacgacccagcuccugccguccggcaucugcgccuuccgcggccgggugaccgcgcagaucaaccagcgcgaccgguggcacaugcagcugcagaaccucaacgggaccacguacgaccccaccgacgacgugcccgccccgcugggcacccccgacuucaagggggucguguucggcauggucagccagcgcaacguggggaacgacgcccccggcuccacccgggcccagcaggccugggugagcacguacagcccccaguucgucccgaagcugggcuccgugaaccuccgcaucagcgacaacgacgacuuccaguuccagcccaccaaguucacccccgugggggucaacgacgacgacgacggccaccccuuccggcagugggagcugccgaacuacuccggggagcugacccucaacaugaaccuggcgccgcccguggcccccaacuuccccggcgagcagcuccuguucuuccgcagcuucgugcccugcuccgggggcuacaaccagggcaucaucgacugccugaucccccaggaguggguccagcacuucuaccaggagagcgcccccucccagagcgacguggcccugauccgguacgugaacccggacacggggcgcacccucuucgaggccaagcugcaccgcuccggcuacaucaccgucgcgcacagcggggacuacccccugguggugcccgccaacggccacuuccgguucgacuccugggucaaccaguucuacagccucgcccccauggggaccggcaacggccgccggcgcgcccaguga

SEQ ID NO: 11336 - RNA, 1623 nt, Artificial Sequence
  derived and/or modified sequence opt1 from VP1__Norovirus_and/or_Norovirus-like__KU557807
augaagauggccagcaacgacguggcccccuccaacgacggcgcggccgggcuggucccggagggcaacaacgagacccucccccuggagcccguggccggggccgccaucgcggcccccgugaccggccagaacaacaucaucgacccguggauccgcacgaacuucguccaggcccccaacggggaguucaccgugagcccccggaacucccccggcgagauccugcucaaccuggagcugggcccggaccucaaccccuaccuggcccaccugagccgcauguacaacggguacgcgggcgggguggagguccaggugcuccuggccggcaacgccuucaccgccgggaagauccuguucgccgcggugccgcccaacuuccccgucgaguuccucucccccgcccagaucaccaugcugccccaccugaucguggacgugcggacgcucgagcccaucaugaucccgcugcccgacguccgcaacaccuucuuccacuacagcaaccagcccaacucccggaugcgccugguggccaugcucuacacgccccugcggagcaacggcuccggcgacgacguguucaccgucagcugccgcgugcugacccggccgacccccgacuucgaguucaccuaccucgugccgcccuccgucgagagcaagaccaagcccuucucccugcccauccugacgcucagcgagcugaccaacucccgcuuccccgugcccaucgacagccuguucaccgcccagaacaacgugcuccagguccagugccagaacgggcggugcacccuggacggcgagcugcaggggacgacccagcuccugccguccggcaucugcgccuuccgcggccgggugaccgcgcagaucaaccagcgcgaccgguggcacaugcagcugcagaaccucaacgggaccacguacgaccccaccgacgacgugcccgccccgcugggcacccccgacuucaagggggucguguucggcauggucagccagcgcaacguggggaacgacgcccccggcuccacccgggcccagcaggccugggugagcacguacagcccccaguucgucccgaagcugggcuccgugaaccuccgcaucagcgacaacgacgacuuccaguuccagcccaccaaguucacccccgugggggucaacgacgacgacgacggccaccccuuccggcagugggagcugccgaacuacuccggggagcugacccucaacaugaaccuggcgccgcccguggcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacgucgcccugauccgguacgugaacccggacacggggcgcacccucuucgaggccaagcugcaccgcuccggcuacaucaccguggcgcacagcggggacuacccccuggucgugcccgccaacggccacuuccgguucgacuccugggugaaccaguucuacagccucgcccccauggggaccggcaacggccgccggcgcgcccaguga

SEQ ID NO: 11337 - RNA, 1623 nt, Artificial Sequence
  derived and/or modified sequence opt1 from VP1__Norovirus_and/or_Norovirus-like__KX371111
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccgaccggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugucccagcgcaacgucgggagcgacgcccccggcuccacgcgggcccagcaggcgugggugagcaccuacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacgcucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacaccgggcgcacccucuucgaggcgaagcugcaccgcuccggcuacaucaccguggcccacagcggggacuacccccuggugguccccgccaacggccacuuccgguucgacuccugggugaaccaguucuacagccucgcccccauggggacgggcaacggccgccggcgcgcgcaguga

SEQ ID NO: 11338 - RNA, 1623 nt, Artificial Sequence
  derived and/or modified sequence opt1 from VP1__Norovirus_and/or_Norovirus-like__KX371110
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcacgaccgcuggcacaugcagcugcagaaccucaacgggaccacguacgaccccaccgacgacgugcccgccccgcugggcacccccgacuucaaggggguggucuucggcauggugagccagcggaacgucgggaccgacgcccccggcuccacgcgcgcccagcaggcgugggugagcaccuacagcccccaguucgugccgaagcugggcuccgucaaccuccggaucagcgacaacgacgacuuccaguuccagcccaccaaguucacccccgugggggugaacgacgacgacgacggccaccccuuccgccagugggagcugccgaacuacuccggggagcugacgcucaacaugaaccuggccccgcccgucgcccccaacuuccccggcgagcagcuccuguucuuccggagcuucgugcccugcuccgggggcuacaaccagggcaucaucgacugccugaucccccaggaguggauccagcacuucuaccaggagagcgcccccucccagagcgacguggcccugauccgcuacgucaacccggacaccgggcggacccucuucgaggcgaagcugcaccgcuccggcuacaucaccguggcccacagcggggacuacccccuggugguccccgccaacggccacuuccgcuucgacuccugggugaaccaguucuacagccucgcccccauggggacgggcaacggccggcgccgggcgcaguga

SEQ ID NO: 11339 - RNA, 1623 nt, Artificial Sequence
  derived and/or modified sequence opt1 from VP1__Norovirus_and/or_Norovirus-like__KX134669
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggaccggcaacggccgccggcgcgcgcaguga

SEQ ID NO: 11340 - RNA, 1623 nt, Artificial Sequence
  derived and/or modified sequence opt1 from VP1__Norovirus_and/or_Norovirus-like__KU557871
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgcgcuccaggugcagugccagaacgggcggugcacccuggacggcgagcugcaggggacgacccagcuccugccguccggcaucugcgccuuccgcggccgggugaccgcccagaucaaccagcgcgaccgguggcacaugcagcugcagaaccucaacgggaccacguacgaccccaccgacgacguccccgccccgcugggcacccccgacuucaagggggugguguucggcauggucagccagcgcaacguggggaacgacgcccccggcuccacccgggcgcagcaggccugggucagcacguacagcccccaguucgugccgaagcugggcuccgugaaccuccgcaucagcgacaacgacgacuuccaguuccagcccaccaaguucacccccgucggggugaacgacgacgacgacggccaccccuuccggcagugggagcugccgaacuacuccggggagcugacccucaacaugaaccuggccccgcccguggcccccaacuuccccggcgagcagcuccuguucuuccgcagcuucguccccugcuccgggggcuacaaccagggcaucaucgacugccugaucccccaggaguggauccagcacuucuaccaggagagcgcccccucccagagcgacguggcgcugauccgguacgugaacccggacacggggcgcacccucuucgaggccaagcugcaccgcuccggcuacaucaccgucgcccacagcggggacuacccccugguggugcccgccaacggccacuuccgguucgacuccugggucaaccaguucuacagccucgcgcccauggggaccggcaacggccgccggcgcgcccaguga

SEQ ID NO: 11341 - RNA, 1623 nt, Artificial Sequence
  derived and/or modified sequence opt1 from VP1__Norovirus_and/or_Norovirus-like__KX371108
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggagauccaggugcuccuggccggcaacgccuucaccgccgggaagauccuguucgcggccgucccgcccaacuuccccguggaguuccucucccccgcccagaucaccaugcugccccaccugaucguggacguccggacgcucgagcccaucaugaucccgcugcccgacgugcgcaacaccuucuuccacuacagcaaccagcccaacucccggaugcgccugguggccaugcucuacacgccccugcggagcaacggcuccggcgacgacgucuucaccgugagcugccgcgugcugacccggccgacccccgacuucgaguucaccuaccucgucccgcccuccguggagagcaagaccaagcccuucucccugcccauccugacgcucagcgagcugaccaacucccgcuuccccgugcccaucgacagccuguucaccgcccagaacaacguccuccaggugcagugccagaacgggcggugcacccuggacggcgagcugcaggggacgacccagcuccugccgaccggcaucugcgcguuccgcggccgggugaccgcccagaucaaccagcgcgaccgguggcacaugcagcugcagaaccucaacgggacgaccuacgaccccaccgacgacguccccgccccgcugggcacccccgacuucaagggggugguguucggcauggucucccagcgcaacguggggagcgacgcccccggcuccacgcgggcccagcaggcgugggucagcaccuacagcccccaguucgugccgaagcugggcuccgugaaccuccgcaucagcgacaacgacgacuuccaguuccagcccaccaaguucacccccgucggggugaacgacgacgacgacggccaccccuuccggcagugggagcugccgaacuacuccggggagcugacgcucaacaugaaccuggccccgcccguggcccccaacuuccccggcgagcagcuccuguucuuccgcagcuucguccccugcuccgggggcuacaaccagggcaucaucgacugccugaucccccaggaguggauccagcacuucuaccaggagagcgcccccucccagagcgacguggcccugauccgguacgugaacccggacaccgggcgcacccucuucgaggcgaagcugcaccgcuccggcuacaucaccgucgcccacagcggggacuacccccugguggugcccgccaacggccacuuccgguucgacuccugggucaaccaguucuacagccucgcccccauggggacgggcaacggccgccggcgcgcgcaguga

SEQ ID NO: 11342 - RNA, 1623 nt, Artificial Sequence
  derived and/or modified sequence opt1 from VP1__Norovirus_and/or_Norovirus-like__KU557829
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucacggacccguggauccgcaccaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucacgaugcugccccaccugaucgucgacgugcggacccucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagacgaagcccuucucccugcccauccugacccucagcgagcugaccaacucccgcuuccccguccccaucgacagccuguucaccgcccagaacaacgugcuccaggugcagugccagaacgggcggugcacgcuggacggcgagcugcaggggaccacccagcuccugccguccggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugagccagcgcaacgucgggaacgacgcccccgacuccacgcgggcccagcaggcgugggugagcaccuacagcccccaguucgugccgaagcugggcuccgucaaccuccgcaucagcgacaacgacgacuuccaguuccagcccaccaaguucacccccgugggcgugaacgacgacgacgacgggcaccccuuccggcagugggagcugccgaacuacuccggcgagcugacgcucaacaugaaccuggccccgcccgucgcccccaacuuccccggggagcagcuccuguucuuccgcagcuucgugcccugcuccggcggguacaaccagggcaucaucgacugccugaucccccaggaguggauccagcacuucuaccaggagagcgcccccucccagagcgacguggcccugauccgguacgucaacccggacaccggccgcacccucuucgaggcgaagcugcaccgcuccggguacaucaccguggcccacagcggcgacuacccccuggugguccccgccaacgggcacuuccgguucgacuccugggugaaccaguucuacagccucgcccccaugggcacggggaacggccgccggcgcgcgcaguga

SEQ ID NO: 11343 - RNA, 1623 nt, Artificial Sequence
  derived and/or modified sequence opt1 from VP1__Norovirus_and/or_Norovirus-like__KX168452
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccgcccccaucgacagccuguucaccgcgcagaacaacguccuccaggugcagugccagaacgggcggugcacccuggacggcgagcugcaggggacgacccagcuccugccguccggcaucugcgccuuccgcggccgggugaccgcccagaucaaccagcgcgaccgguggcacaugcagcugcagaaccucaacgggaccacguacgaccccaccgacgacguccccgccccgcugggcacccccgacuucaagggggugguguucggcauggucagccagcgcaacgugggguccgacgcccccggcagcacccgggcgcagcaggccugggucagcacguacagcccccaguucgugccgaagcugggcuccgugaaccuccgcaucuccgacaacgacgacuuccaguuccagcccaccaaguucacccccgucggggugaacgacgacgacgacggccaccccuuccggcagugggagcugccgaacuacagcggggagcugacccucaacaugaaccuggccccgcccguggcccccaacuuccccggcgagcagcuccuguucuuccgcuccuucguccccugcagcgggggcuacaaccagggcaucaucgacugccugaucccccaggaguggauccagcacuucuaccaggaguccgcccccagccaguccgacguggcgcugauccgguacgugaacccggacacggggcgcacccucuucgaggccaagcugcaccgcagcggcuacaucaccgucgcccacuccggggacuacccccugguggugcccgccaacggccacuuccgguucgacagcugggucaaccaguucuacucccucgcgcccauggggaccggcaacggccgccggcgcgcccaguga

SEQ ID NO: 11344 - RNA, 1623 nt, Artificial Sequence
  derived and/or modified sequence opt1 from VP1__Norovirus_and/or_Norovirus-like__KU953393
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccagcaucugcgcguuccgcggccgggucaccgcccagaucaaccagcgcgaccgguggcacaugcagcugcagaaccucaacggcaccacguacgaccccaccgacgacgugcccgccccgcuggggacccccgacuucaagggcguggucuucgggauggugucccagcgcaacgucggcagcgacgcccccgggagcacccgggcccagcaggcguggguguccacguacagcccccaguucgugccgaagcugggcuccgucaaccuccgcaucagcgacaacgacgacuuccaguuccagcccaccaaguucacccccgugggcgugaacgacgacgacgacgggcaccccuuccggcagugggagcugccgaacuacuccggcgagcugacccucaacaugaaccuggccccgcccgucgcccccaacuuccccggggagcagcuccuguucuuccgcagcuucgugcccugcuccggcggguacaaccagggcaucaucgacugccugaucccccaggaguggauccagcacuucuaccaggagagcgcccccucccagagcgacguggcccugauccgguacgucaacccggacacgggccgcacccucuucgaggcgaagcugcaccgcuccggguacaucaccguggcccacagcggcgacuacccccuggugguccccgccaacgggcacuuccgguucgacuccugggugaaccaguucuacagccucgcccccaugggcaccgggaacggccgccggcgcgcgcaguga

SEQ ID NO: 11345 - RNA, 1623 nt, Artificial Sequence
  derived and/or modified sequence opt1 from VP1__Norovirus_and/or_Norovirus-like__KR052020
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagccggacguggcccugauccgguacgucaaccccgacacggggcgcacccucuucgaggcgaagcugcaccgcagcggcuacaucaccguggcccacuccggggacuacccccuggugguccccgccaacggccacuuccgguucgacagcugggugaaccaguucuacucccucgccccgauggggaccggcaacggccgccggcgcgcgcaguga

SEQ ID NO: 11346 - RNA, 1623 nt, Artificial Sequence
  derived and/or modified sequence opt1 from VP1__Norovirus_and/or_Norovirus-like__KT315687
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccaguccaacgugcuccaggugcagugccagaacgggcggugcacccuggacggcgagcugcaggggacgacccagcuccugccgaccggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugagccagcgcaacgucgggaacgacgcccccggcuccacgcgggcccagcaggcgugggugagcaccuacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacgcucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacaccgggcgcacccucuucgaggcgaagcugcaccgcuccggcuacaucaccguggcccacagcggggacuacccccuggugguccccgccaacggccacuuccgguucgacuccugggugaaccaguucuacagccucgcccccauggggacgggcaacggccgccggcgcgcgcaguga

SEQ ID NO: 11347 - RNA, 1623 nt, Artificial Sequence
  derived and/or modified sequence opt1 from VP1__Norovirus_and/or_Norovirus-like__KX356908
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccuguccagcgacaucugcgcguuccgcggccgggucaccgcccagaucaaccagcgcgaccgguggcacaugcagcugcagaaccucaacggcaccacguacgacccgaccgacgacgugcccgcgccccuggggaccccggacuucaagggcguggucuucgggauggugucccagcgcaacgucggcagcgacgcccccgggagcacccgggcccagcaggccuggguguccacguacagcccccaguucgugcccaagcugggcuccgucaaccuccgcaucagcgacaacgacgacuuccaguuccagccgaccaaguucacccccgugggcgugaacgacgacgacgacgggcaccccuuccggcagugggagcugcccaacuacuccggcgagcugacccucaacaugaaccuggccccgcccgucgcccccaacuuccccggggagcagcuccuguucuuccgcagcuucgugccgugcuccggcggguacaaccagggcaucaucgacugccugaucccccaggaguggauccagcacuucuaccaggagagcgcccccucccagagcgacguggcccugauccgguacgucaaccccgacacgggccgcacccucuucgaggcgaagcugcaccgcuccggguacaucaccguggcccacagcggcgaccacccgcuggugguccccgccaacgggcacuuccgguucgacuccugggugaaccaguucuacagccucgcccccaugggcaccgggaacggccgccggcgcgcgcaguga

SEQ ID NO: 11348 - RNA, 1623 nt, Artificial Sequence
  derived and/or modified sequence opt1 from VP1__Norovirus_and/or_Norovirus-like__KX024652
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccaccccaccaaguucacccccgugggggugaacgacgacaacgacgggcccccguuccggcagugggagcugcccaacuacuccggcgagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgccccgucccagagcgacguggcccugauccgguacgucaaccccgacacggggcgcacccucuucgaggcgaagcugcaccgcuccggcuacaucaccguggcccacagcggggacuacccccuggugguccccgccaacggccacuuccgguucgacuccugggugaaccaguucuacagccucgccccgauggggaccggcaacggccgccggcgcgcgcaguga

SEQ ID NO: 11349 - RNA, 1623 nt, Artificial Sequence
  derived and/or modified sequence opt1 from VP1__Norovirus_and/or_Norovirus-like__KT315706
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgaccuccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugcccagcggcaucugcgcguuccgcggccgggucaccgcccagaucaaccagcgcgaccgguggcacaugcagcugcagaaccucaacgggaccacguacgacccgaccgacgacgugcccgcgccccugggcaccccggacuucaaggggguggucuucggcauggugucccagcgcaacgucgggaacgacgcccccggcagcacccgggcccagcaggccugggugagcacguacagcccccaguucgugcccaagcugggcuccgucaaccuccgcaucuccgacaacgacgacuuccaguuccagccgaccaaguucacccccgugggggugaacgacgacgacgacggccaccccuuccggcagugggagcugcccaacuacagcggggagcugacccucaacaugaaccuggccccgcccgucgcccccaacuuccccggcgagcagcuccuguucuuccgcuccuucgugccgugcagcgggggcuacaaccagggcaucaucgacugccugaucccccaggaguggauccagcacuucuaccaggaguccgcccccagccaguccgacguggcccugauccgguacgucaaccccgacacggggcgcacccucuucgaggcgaagcugcaccgcagcggcuacaucaccguggcccacuccggggacuacccgcuggugguccccgccaacggccacuuccgguucgacagcugggugaaccaguucuacucccucgcccccauggggaccggcaacggccgccggcgcgcgcaguga

SEQ ID NO: 11350 - RNA, 1623 nt, Artificial Sequence
  derived and/or modified sequence opt1 from VP1__Norovirus_and/or_Norovirus-like__KX134670
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugaccaugccgacccccgacuucgaguucaccuaccucgugccgcccuccguggagagcaagaccaagcccuucucccugcccauccugacgcucagcgagcugaccaacucccgguuccccguccccaucgacagccuguucaccgcccagaacaacgugcuccaggugcagugccagaacgggcgcugcacccuggacggcgagcugcaggggacgacccagcuccugccgaccggcaucugcgcguuccggggccgcgucaccgcccagaucaaccagcgggaccgcuggcacaugcagcugcagaaccucaacgggacgaccuacgaccccaccgacgacgugcccgccccgcugggcacccccgacuucaaggggguggucuucggcauggugucccagcggaacgucgggaacgacgcccccggcagcacgcgcgcccagcaggcguggguguccaccuacagcccccaguucgugccgaagcugggcagcgucaaccuccggaucuccgacaacgacgacuuccaguuccagcccaccaaguucacccccgugggggugaacgacgacgacgacggccaccccuuccgccagugggagcugccgaacuacagcggggagcugacgcucaacaugaaccuggccccgcccgucgcccccaacuuccccggcgagcagcuccuguucuuccgguccuucgugcccugcagcgggggcuacaaccagggcaucaucgacugccugaucccccaggaguggauccagcacuucuaccaggaguccgcccccagccaguccgacguggcccugauccgcuacgucaacccggacaccgggcggacccucuucgaggcgaagcugcaccgcagcggcuacaucaccguggcccacuccggggacuacccccuggugguccccgccaacggccacuuccgcuucgacagcugggugaaccaguucuacucccucgcccccauggggacgggcaacggccggcgccgggcgcaguga

SEQ ID NO: 11351 - RNA, 1623 nt, Artificial Sequence
  derived and/or modified sequence opt1 from VP1__Norovirus_and/or_Norovirus-like__KT780399
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugcaccguccugacccgcccgacccccgacuucgaguucaccuaccucgugccgcccuccguggagagcaagacgaagcccuucucccugcccauccugacccucagcgagcugaccaacucccgguuccccguccccaucgacagccuguucaccgcccagaacaacgugcuccaggugcagugccagaacgggcgcugcacgcuggacggcgagcugcaggggaccacccagcuccugccgaccggcaucugcgcguuccggggccgcgucacggcccagaucaaccagcgggaccgcuggcacaugcagcugcagaaccucaacgggaccaccuacgaccccaccgacgacgugcccgccccgcugggcacgcccgacuucaaggggguggucuucggcauggugucccagcggaacgucgggaacgacgcccccggcagcacccgcgcccagcaggcguggguguccaccuacagcccccaguucgugccgaagcugggcagcgucaaccuccggaucuccgacaacgacgacuuccaguuccagcccaccaaguucacgcccgugggggugaacgacgacgacgacggccaccccuuccgccagugggagcugccgaacuacagcggggagcugacccucaacaugaaccuggccccgcccgucgcccccaacuuccccggcgagcagcuccuguucuuccgguccuucgugcccugcagcgggggcuacaaccagggcaucaucgacugccugaucccccaggaguggauccagcacuucuaccaggaguccgcccccagccaguccgacguggcccugauccgcuacgucaacccggacaccgggcggacccucuucgaggcgaagcugcaccgcagcggcuacaucacgguggcccacuccggggacuacccccuggugguccccgccaacggccacuuccgcuucgacagcugggugaaccaguucuacucccucgcccccauggggaccggcaacggccggcgccgggcgcaguga

SEQ ID NO: 11352 - RNA, 1623 nt, Artificial Sequence
  derived and/or modified sequence opt1 from VP1__Norovirus_and/or_Norovirus-like__KP902577
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugcacgguccugaccaccccgacccccgacuucgaguucacguaccucgugccgcccuccguggagagcaagaccaagcccuucucccugcccauccugacccucagcgagcugaccaacucccgcuuccccguccccaucgacagccuguucacggcccagaacaacgugcuccaggugcagugccagaacgggcggugcacccuggacggcgagcugcaggggaccacccagcuccugccgacgggcaucugcgcguuccgcggccgggucaccgcccagaucaaccagcgcgaccgguggcacaugcagcugcagaaccucaacgggaccaccuacgaccccacggacgacgugcccgccccgcugggcacccccgacuucaaggggguggucuucggcauggugucccagcgcaacgucgggaacgacgcccccggcagcacccgggcccagcaggcguggguguccaccuacagcccccaguucgugccgaagcugggcagcgucaaccuccgcaucuccgacaacgacgacuuccaguuccagcccacgaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacaccgggcgcacccucuucgaggcgaagcugcaccggagcggcuacaucaccguggcccacuccggggacuacccccuggugguccccgccaacggccacuuccgcuucgacagcugggugaaccaguucuacucccucgcccccauggggaccggcaacggccgccggcgcgcgcaguga

SEQ ID NO: 11353 - RNA, 1623 nt, Artificial Sequence
  derived and/or modified sequence opt1 from VP1__Norovirus_and/or_Norovirus-like__KU587628
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccuacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaacaagcccuucucccugcccaucuucacccugagcgagcucacgaacucccgcuuccccguccccaucgacagccuguucaccgcccagaacaacgugcuccaggugcagugccagaacgggcggugcacccuggacggcgagcugcaggggaccacgcagcugcucccgaccggcaucugcgcguuccgcggccgggucaccgcccagaucaaccagcgcgaccgguggcacaugcagcugcagaaccugaacgggaccacguacgaccccaccgacgacgugcccgccccgcucggcacccccgacuucaaggggguggucuucggcauggugucccagcgcaacgucgggaacgacgcccccggcagcacccgggcccagcaggcguggguguccacguacagcccccaguucgugccgaagcugggcagcgucaaccugcgcaucuccgacaacgacgacuuccaguuccagcccaccaaguucacccccgugggggugaacgacgacgacgacggccaccccuuccggcagugggagcucccgaacuacagcggggagcugacccugaacaugaaccucgccccgcccgucgcccccaacuuccccggcgagcagcugcuguucuuccgcuccuucgugcccugcagcgggggcuacaaccagggcaucaucgacugccucaucccccaggaguggauccagcacuucuaccaggaguccgcccccagccaguccgacguggcccugauccgguacgucaacccggacacggggcgcacccuguucgaggcgaagcuccaccgcagcggcuacaucaccguggcccacuccggggacuacccccuggugguccccgccaacggccacuuccgguucgacagcugggugaaccaguucuacucccuggcccccauggggaccggcaacggccgccggcgcgcgcaguga

SEQ ID NO: 11354 - RNA, 1623 nt, Artificial Sequence
  derived and/or modified sequence opt1 from VP1__Norovirus_and/or_Norovirus-like__AF414409
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacuccggcgacgacgucuucaccgugagcugccgggugcucaccaagccgucccccgacuucgaguucaccuuccuggucccgcccaccguggagagcaagaccaagcaguucacgcugcccauccucaagaucuccgagaugaccaacagccgcuuccccgugcccgucgagaugauguacaccucccggaacgagaaccagguggugcagccccagaacgggcgcgucacccuggacggcgagcugcucgggacgaccccgcugcuggccgugaacaucugcaaguucaagggcgaggugaucgcgaagaacggcgacguccggagcuaccgcauggacauggagaucaccaacaccgacgggacgcccaucgaccccaccgaggacaccccgggccccaucgggucccccgacuuccagggcauccucuucgggguggccagccagcggaacaagaacgagcagaaccccgccacccgcucccacgaggccaacaucaacacgggcggcgaccaguacgccccgaagcuggcgcaggucaagaucuucagccagucccaggacuucgaggugcaccagcccaccguguucacccccgucgggguggccggcgacaccagccaccccuuccggcaguggacgcugccgcgcuacgggggccaccucaccaacaacacccaccuggcccccgccguggcgccccuguuccccggggagcagauccucuucuuccggagccagaucccguccagcggcggccacgagcugggguacauggacugccuggucccccaggagugggugcagcacuucuaccaggaggccgccaccgcccaguccgagguggcccucauccgcuucaucaaccccgacacgggccggguccuguucgaggcgaagcugcacaagcagggguucaucaccguggcccacaccggcgacaaccccaucgugaugccgcccaacggguacuuccgcuucgaggccugggucaaccaguucuacagccucgcccccgugggcaccggcaacgggcggcgccgcauccaguga

SEQ ID NO: 11355 - RNA, 1623 nt, Artificial Sequence
  derived and/or modified sequence opt1 from VP1__Norovirus_and/or_Norovirus-like__KT943504
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaccaacuucgugcaggcccccgccggcgaguucacggugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucaccgccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacuccggcgacgacgucuucaccgugagcugccgggugcucaccaagccgucccccgacuucgaguucaccuuccuggucccgcccaccguggagagcaagacgaagcaguucacccugcccauccucaagaucuccgagaugaccaacagccgcuuccccgugcccgucgagaugauguacaccgcccggaacgagaaccagguggugcagccccagaacgggcgcgucacgcuggacggcgagcugcucgggaccaccccgcugcuggcggugaacaucugcaaguucaagggcgagaucaccgccaaguccguggacguccggagcuaccgcauggacauggagaucacgaacaccgacggcacccccaucgaccccaccgaggacacgccggggcccaucggcucccccgacuuccgggggauccucuucggcguggccagccagcgcaacaagggggagcagauccccgccacccgggcccacgaggcgaacaucaacaccggcggcgaccaguacgccccgaagcuggcccaggucaaguucuucuccgggagccaggacuucgaggugcaccagcccaccguguucacgcccgucggcguggccggggacuccagccaccccuuccagcagugggcccugccgcgcuacggcgggcaccucaccaacaacacccaccuggcgcccgccguggcgccccuguuccccggcgagcagauccucuucuuccggagccagaucccguccagcggcgggcacgagaugggcuacauggacugccuggucccccaggagugggugcagcacuucuaccaggaggccgccaccgcccaguccgagguggcccugauccgcuucgucaaccccgacacggggcggguccucuucgaggccaagcugcacaagcagggcuucaucaccguggcccacaccggggacaaccccaucgugaugccgcccaacggccacuuccgcuucgaggcgugggugaaccaguucuacagccuggcccccgugggcaccgggaacggccggcgccgcauccaguga

SEQ ID NO: 11356 - RNA, 1623 nt, Artificial Sequence
  derived and/or modified sequence opt1 from VP1__Norovirus_and/or_Norovirus-like__KT943505
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaccaacuucgugcaggcccccgccggcgaguucacggugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucaccgccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacuccggcgacgacgucuucaccgugagcugccgggugcucaccaagccgucccccgacuucgaguucaccuuccuggucccgcccaccguggagagcaagacgaagcaguucacccugcccauccucaagaucuccgagaugaccaacagccgcuuccccgugcccgucgagaugauguacaccgcccggaacgagaaccagguggugcagccccagaacgggcgcgucacgcuggacggcgagcugcucgggaccaccccgcugcuggcggugaacaucugcaaguucaagggcgagaucaccgccaaguccguggacguccggagcuaccgcauggacauggagaucacgaacaccgacggcacccccaucgaccccaccgaggacacgccggggcccaucggcucccccgacuuccgggggauccucuucggcguggccagccagcgcaacaagggggagcagauccccgccacccgggcccacgaggcgaacaucaacaccggcggcgaccaguacgccccgaagcuggcccaggucaaguucuucuccgggagccaggacuucgaggugcaccagcccaccguguucacgcccgucggcguggccggggacuccagccaccccuuccagcagugggcccugccgcgcuacggcgggcaccucaccaacaacacccaccuggcgcccgccguggcgccccuguuccccggcgagcagauccucuucuuccggagccagaucccguccagcggcgggcacgagcugggcuacauggacugccuggucccccaggagugggugcagcacuucuaccaggaggccgccaccgcccaguccgagguggcccucauccgcuucgucaaccccgacacggggcgggugcuguucgaggccaagcugcacaagcagggcuucaucaccguggcccacaccggggacaaccccaucgucaugccgcccaacggccacuuccgcuucgaggcgugggugaaccaguucuacagccucgcccccgugggcaccgggaacggccggcgccgcauccaguga

SEQ ID NO: 11357 - RNA, 1623 nt, Artificial Sequence
  derived and/or modified sequence opt1 from VP1__Norovirus_and/or_Norovirus-like__KT962982
augaagauggccagcaacgacgccgcgcccuccaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugucccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacccggcccacgcccgacuucgaguucaccuaccuggugcccccguccgucgagagcaagaccaagcccuucacccuccccauccugacgaucggcgagcugaccaacucccgcuuccccgccccgaucgaccagcucuacaccagccccaacgccgacguggugguccagccccagaacgggcggugcacccuggacggcgagcugcaggggacgacccagcuccugaccaccgccaucugcuccuacaagggcacgaccagcaacccgaccuccgacuacugggacgaccaccuccugcaccuggugcaccccaacggcgccaccuacgaccccacggaggacgugcccgccccguucgggacccaggacuuccgcggcauccuguacgggguccucacccagaacacccagaacccccgggacgaggugagcaacucccgcggcaucuacaucagcuccacgagcgacaaguucacccccaagcuggggaccaucggccugcaccagguccagggcgacaccgcgagcaaccagcaguccaaguucacgcccguggggaucgccgugaaccagaacaccccguucaagcagugggagcuccccaacuacagcggcgcccugacccugaacaccaaccucgcccccgccgucgggcccaacuucccgggcgagcagauccuguucuuccgguccaacgugcccagcgugcaggggaaccaccccacgcaggagaucgacugccugaucccccaggagugggucucccacuucuaccaggagagcgcgccgucccagagcgacguggcccucgugcgcuacgucaaccccgacaccggccggaccaucuucgaggccaagcugcaccgccagggcuucaucaccaucgccgcgaccggguccaaccccgugguggugcccccgaacggcuacuuccgguucgacagcugggucaaccaguucuacgcccuggcccccauggggacgggcaacgggcgccggcgcgcccaguga

SEQ ID NO: 11358 - RNA, 1623 nt, Artificial Sequence
  derived and/or modified sequence opt1 from VP1__Norovirus_and/or_Norovirus-like__KX079488
augaagauggccagcaacgacgccgcgcccuccaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugucccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacccggcccacgcccgacuucgaguucaccuaccuggugcccccguccgucgagagcaagaccaagcccuucacccuccccauccugacgaucggcgagcugaccaacucccgcuuccccgccccgaucgaccagcucuacaccagccccaacgccgacguggugguccagccccagaacgggcggugcacccuggacggcgagcugcaggggacgacccagcuccugaccaccgccaucugcuccuaccgcggcacgaccagcaacccgaccuccgacuacugggacgaccaccuccugcaccuggugcaccccaacggcgccaccuacgaccccacggaggacgugcccgccccguucgggacccaggacuuccggggcauccuguacgggguccucacccagaacacccagaacccccgcgacgaggugagcaacucccggggcaucuacaucagcuccacgagcgacaaguucacccccaagcuggggaccaucggccugcaccagguccagggcgacaccgcgagcaaccagcaguccaaguucacgcccguggggaucgccgugaaccagaacaccccguucaagcagugggagcuccccaacuacagcggcgcccugacccugaacaccaaccucgcccccgccgucgggcccaacuucccgggcgagcagauccuguucuuccgcuccaacgugcccagcgugcaggggaaccaccccacgcaggagaucgacugccugaucccccaggagugggucucccacuucuaccaggagagcgcgccgucccagagcgacguggcccucgugcgguacgucaaccccgacaccggccgcaccaucuucgaggccaagcugcaccggcagggcuucaucaccaucgccgcgaccggguccaaccccgugguggugcccccgaacggcuacuuccgcuucgacagcugggucaaccaguucuacgcccuggcccccauggggacgggcaacgggcggcgccgcgcccaguga

SEQ ID NO: 11359 - RNA, 1623 nt, Artificial Sequence
  derived and/or modified sequence opt1 from VP1__Norovirus_and/or_Norovirus-like__KR921938
augaagauggccagcaacgacgccgcgcccuccaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugucccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacccggcccacgcccgacuucgaguucaccuaccuggugcccccguccgucgagagcaagaccaagcccuucacccuccccauccugacgaucggcgagcugaccaacucccgcuuccccgccccgaucgaccagcucuacaccagccccaacgccgacguggugguccagccccagaacgggcggugcacccuggacggcgagcugcaggggacgacccagcuccugaccaccgccaucugcuccuaccgcggcacgaccagcaacccgaccuccgacuacugggacgaccaccuccugcaccuggugcaccccaacggcgccaccuacgaccccacggaggacgugcccgccccguucgggacccaggacuuccggggcauccuguacgggguccucacccagaacacccagaacccccgcgacgaggugagcaacucccggggcaucuacaucagcuccacgagcgacaaguucacccccaagcuggggaccaucggccugcaccagguccagggcgacaccgcgagcaaccagcaguccaaguucacgcccguggggaucgccgugaaccagaacaccccguucaagcagugggagcuccccaacuacagcggcgcccugacccugaacaccaaccucgcccccgccgucgggcccaacuucccgggcgagcagauccuguucuuccgcuccaacgugcccagcgugcaggggaaccaccccacgcaggagaucgacugccugaucccccaggaguggaucucccacuucuaccaggagagcgcgccgucccagagcgacgucgcccucgugcgguacgugaaccccgacaccggccgcaccaucuucgaggccaagcugcaccggcagggcuucaucaccaucgccgcgaccggguccaaccccgucguggugcccccgaacggcuacuuccgcuucgacagcugggucaaccaguucuacgcccuggcccccauggggacgggcaacgggcggcgccgcgcccaguga

SEQ ID NO: 11360 - RNA, 1623 nt, Artificial Sequence
  derived and/or modified sequence opt1 from VP1__Norovirus_and/or_Norovirus-like__KR921940
augaagauggccagcaacgacgccgcgcccuccaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugucccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacccggcccacgcccgacuucgaguucaccuaccuggugcccccguccgucgagagcaagaccaagcccuucacccuccccauccugacgaucggcgagcugaccaacucccgcuuccccgccccgaucgaccagcucuacaccagccccaacgccgacguggugguccagccccagaacgggcggugcacccuggacggcgagcugcaggggacgacccagcuccugaccaccgccaucugcuccuaccgcggcacgaccagcaacccgaccuccgacuacugggacgaccaccuccugcaccuggugcaccccaacggcgccaccuacgaccccacggaggacgugcccgccccguucgggacccaggacuuccggggcauccuguacgggguccucacccagaacacccagaacccccgcgacgaggugagcaacucccggggcaucuacaucagcuccacgagcgacaaguucacccccaagcuggggaccaucggccugcaccagguccagggcgacaccgcgagcaaccagcaguccaaguucacgcccguggggaucgccgugaaccagaacaccccguucaagcagugggagcuccccaacuacagcggcgcccugacccugaacaccaaccucgcccccgccgucgggcccaacuucccgggcgagcagauccuguucuuccgcuccaacgugcccagcgugcaggggaaccaccccacgcaggagaucgacugccugaucccccaggagugggucucccacuucuaccaggagagcgcgccgucccagagcgacguggcccucgugcgguacgucaaccccgacaccggccgcaccaccuucgaggccaagcugcaccggcagggcuucaucaccaucgccgcgacgggguccaaccccgugguggugcccccgaacggcuacuuccgcuucgacagcugggucaaccaguucuacgcccuggcccccauggggaccggcaacgggcggcgccgcgcccaguga

SEQ ID NO: 11361 - RNA, 1623 nt, Artificial Sequence
  derived and/or modified sequence opt1 from VP1__Norovirus_and/or_Norovirus-like__DQ358209
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucguguucgcggccaucccgcccggguuccccuacgagaaccugucccccagccagaucaccaugugcccccacgucaucaucgacgugcggcagcuggagcccgugcuccugcugaugccggacaucaagaacaacuucuuccacuacaaccagggcaacgaccccaagcuccgccuggucgccaugcuguacacgccccuccgggccaacaacuccggcgacgacguguucaccgugagcugccgcguccugaccaagcccuccccggacuucgaguucaccuuccuggugccgcccaccguggagagcaagaccaagcaguucacgcuccccauccugaagaucuccgagaugaccaacagccgguuccccguccccguggagaugauguacaccgcccgcaacgagaaccaggugguccagccccagaacgggcgggugacccuggacggcgagcuccuggggacgacgccccugcucgcggugaacaucugcaaguucaagggcgaggucaucgccaagaacggcgacgugcgcuccuaccggauggacauggagaucaccaacaccgacgggaccccgaucgaccccaccgaggacacccccggcccgaucgggagccccgacuuccagggcauccuguucggggucgccucccagcgcaacaagaacgagcagaaccccgccacccgggcccaggaggugaacaucaacacgggcggcgaccaguacgcgcccaagcuggcccaggugaaguucuucagcgagucccaggacuucgagguccaccagccgaccguguucacccccgugggggucgccggcgaccccagccaccccuuccgccaguggacccucccgcgguacgggggccaccugacgaacaacauccaccuggcccccgccguggcgccccucuuccccggggagcagauccuguucuuccgcucccagaucccgagcagcggcggccacgagcugggguacauggacugccucgugccccaggaguggguccagcacuucuaccaggaggccgccaccgcccaguccgagguggcgcugauccgguucaucaaccccgacaccggccgcgugcuguucgaggccaagcuccacaagcagggguucaucaccgucgcccacacgggcgacaaccccaucgugaugccgcccaacggguacuuccgguucgaggccugggugaaccaguucuacagccuggcccccgucggcaccggcaacgggcgccggcgcgugcaguga

SEQ ID NO: 11362 - RNA, 1623 nt, Artificial Sequence
  derived and/or modified sequence opt1 from VP1__Norovirus_and/or_Norovirus-like__KP784694
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgacccgcccaacuucccgacggaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucguggugcagccccagaacgggcgcugcaccacggacggcguccuccuggggaccacccagcucucccccgugaacaucugcaccuuccggggcgacgucacgcacaucgccggcagccacaacuacaccaugaaccuggccacccagaacuggaacuccuacgacccgaccgaggagauccccgcgccccuggggacgcccgacuucgugggcaagauccagggggugcucacccagaccaccaagacggacggcagcacccgcagccacaaggccaccgucuacaccggguccgccgacuucgccccgaagcugggccgggugcaguucgagacggacaccaacaacgacuucgagaccaaccagaacaccaaguucacgcccgugggcgucauccagaacggggagaccgcccaccgcaacgagccccagcagugggugcugcccagcuacuccggccggaacaccccgaacgugcaccucgcgcccgccgucgcccccaccuuccccggggagcagcugcuguucuuccgcagcacgaugccgggcugcuccggguaccccaacauggaccucgacugccugcugccccaggagugggugcaguacuucuaccaggaggccgcgcccgcccagagcgacguggcccuccugcgguucgucaacccggacaccggccgcgugcuguucgagugcaagcuccacaaguccggcuacgugaccgucgcccacaccgggagccacgaccuggugaucccgcccaacggcuacuuccgguucgacuccugggugaaccaguucuacacccuggcccccauggggaacggcacggggcgccggcgcgcgaccuga

SEQ ID NO: 11363 - RNA, 1623 nt, Artificial Sequence
  derived and/or modified sequence opt1 from VP1__Norovirus_and/or_Norovirus-like__KX354064
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggccauguga

SEQ ID NO: 11364 - RNA, 1623 nt, Artificial Sequence
  derived and/or modified sequence opt1 from VP1__Norovirus_and/or_Norovirus-like__LC177658
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccgggccgacggcagcacccgcgggcacaaggccacggucuacaccggcagcgccgacuucgccccgaagcugggccgggugcaguucgagaccgacaccgaccacgacuucgaggcgaaccagaacacgaaguucacccccgugggggucauccaggacggcgggaccacccaccgcaacgagccccagcagugggugcugcccuccuacagcggccggaacacgcacaacgugcaccucgccccggccgucgcccccaccuuccccggggagcagcugcuguucuuccgcuccaccaugcccggcugcagcggcuacccgaacauggaccucgacugccugcugccccaggagugggugcaguacuucuaccaggaggcggcccccgcccaguccgacguggcccuccugcgguucgucaaccccgacaccgggcgcgugcuguucgagugcaagcuccacaagagcggcuacgugacggucgcccacaccgggcagcacgaccuggugaucccgcccaacggcuacuuccgguucgacuccugggugaaccaguucuacacccuggcgcccauggggaacggcgccggccgccgccgggucgccuga

SEQ ID NO: 11365 - RNA, 1623 nt, Artificial Sequence
  derived and/or modified sequence opt1 from VP1__Norovirus_and/or_Norovirus-like__KX514232
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccagcuacuccggccgggacacccccaacgugcaccuggcccccgcggucgccccgaccuuccccggggagcagcuccucuucuuccgcagcaccauccccggcugcggcgggcaccccaacaugaaccuggacugccugcucccgcaggagugggugcagcacuucuaccaggaggccgcccccgcgcaguccgacguggcccugcugcgguucgucaaccccgacacgagccgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgcaagcgcgccuccuga

SEQ ID NO: 11366 - RNA, 1623 nt, Artificial Sequence
  derived and/or modified sequence opt1 from VP1__Norovirus_and/or_Norovirus-like__LC145787
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacgugcccgcgccccucggcgugccggacuuccaggggcgggucuucggcaucaucucccagcgcgacaagcacaacagccccgggcacaacgagcccgcgaaccggggccacgacgccguggugcccacguacaccgcccaguacaccccgaagcugggccagauccagaucgggaccuggcagacggacgaccugaccgucaaccagcccgugaaguucacccccgugggccucaacgacaccgagcacuucaaccagugggucgugccccgcuacgccggggcccugaaccugaacacgaaccucgcgccgagcguggcccccgucuuccccggcgagcggcugcuguucuuccgcuccuacgugccccucaagggcggguacggcaacccggccaucgacugccugcugccccaggagugggugcagcacuucuaccaggaggccgcgcccagcauguccgaggucgcccucgugcgguacaucaaccccgacaccgggcgcgcccuguucgaggccaagcugcaccgggccggcuucaugaccgugagcuccaacaccagcgcgccggucguggugcccgccaacggguacuuccgcuucgacuccugggucaaccaguucuacagccucgcccccaugggcacggggaacggccggcgccgcuga

SEQ ID NO: 11367 - RNA, 1623 nt, Artificial Sequence
  derived and/or modified sequence opt1 from VP1__Norovirus_and/or_Norovirus-like__KT962983
augaagauggccagcaacgacgccgcgcccuccaccgacggcgccgccgggcuggugccggagagcaacaccgaggucauggcccucgagcccguggccggcgcggcccuggccgcccccgugacggggcagaccaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucacgauguucccccacgugaucaucgacguccggacccucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacgcugcccauccucacccugggcgagcugagcaacucccgguuccccgucagcaucgaccagauguacaccucccccaacgaggugaucagcgugcagugccagaacgggcgcugcacccucgacggcgagcugcaggggacgacccagcugcaggucuccggcaucugcgccuucaagggcgaggugaccgcccaccuccacgacaacgaccaccuguacaacaucaccaucacgaaccugaacgggagccccuucgacccguccgaggacauccccgcgccccucggcgucccggacuuccaggggcggguguucggcaucaucagccagcgcgacaagcacaacucccccgggcacaacgagcccgcgaaccggggccacgacgccgugguccccaccuacaccgcccaguacaccccgaagcugggccagauccagaucgggacguggcagaccgacgaccugaccgugaaccagcccgugaaguucacccccgucggccucaacgacacggagcacuucaaccaguggguggugccccgcuacgccggggcccugaaccugaacaccaaccucgcgccgagcgucgcccccguguuccccggcgagcggcugcuguucuuccgcagcuacaucccccucaagggcggguacggcaacccggccaucgacugccugcugccccaggagugggugcagcacuucuaccaggaggccgcgcccuccaugagcgaggucgcccucgugcgguacaucaaccccgacaccgggcgcgcccuguucgaggccaagcugcaccgggccggcuucaugaccguguccagcaacacguccgcgccggucguggugcccgccaacggguacuuccgcuucgacagcugggucaaccaguucuacucccucgcccccaugggcaccgggaacggccggcgccgcuga

SEQ ID NO: 11368 - RNA, 1623 nt, Artificial Sequence
  derived and/or modified sequence opt1 from VP1__Norovirus_and/or_Norovirus-like__AB629946
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguucaccgucuccaucgaccagauguacaccagccucaacgaggugaucuccgugcagugccagaacgggcgcugcacccuggacggcgagcugcgggggacgacccagcuccaggucagcggcaucugcgccuucaagggcgaggugaccgcccacguccacgacaacgaccaccuguacaacgugaccaucacgaaccugaacgggucccccuucgaccccagcgaggacgugcccgccccgcucggcguccccgacuuccaggggcgcguguucggcaucaucucccagcgggacaagcacaacagccccgggcacaacgagccggcgaaccgcggccacgacgccgugguccccaccuacaccgcccaguacacccccaagcugggccagauccagaucgggacguggcagaccgacgaccugaccgugaaccagcccgugaaguucaccccggucggccucaacgacacggagcacuucaaccaguggguggugccccgguacgccggggcccugaaccugaacaccaaccucgcgcccagcgucgcccccguguucccgggcgagcgccugcuguucuuccgguccuacgugccccucaagggcggguacggcaaccccgccaucgacugccugcugccccaggaguggguccagcacuucuaccaggaggccgcgccgagcauguccgagguggcccucgugcgcuacaucaaccccgacaccgggcgggcccuguucgaggccaagcugcaccgcgccggcuucaugaccgucagcuccaacacgagcgcgcccguggugguccccgccaacggguacuuccgguucgacuccugggugaaccaguucuacagccucgccccgaugggcaccgggaacggccgccgccgguga

SEQ ID NO: 11369 - RNA, 1623 nt, Artificial Sequence
  derived and/or modified sequence opt1 from VP1__Norovirus_and/or_Norovirus-like__AB809993
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggccgccgccgguga

SEQ ID NO: 11370 - RNA, 1623 nt, Artificial Sequence
  derived and/or modified sequence opt1 from VP1__Norovirus_and/or_Norovirus-like__JQ743330
augaugauggccagcaaggacgcgcccccgaacauggacggcaccuccggggccggccagcuggugcccgaggccaacaccgccgagcccaucagcauggagcccgucgccggggccgcgacggccgccgccaccgcgggccaggugaacaugaucgacccguggaucaugaacaacuacgugcaggcgccccagggggaguucaccaucucccccaacaacacccccggcgacauccucuucgaccugcagcugggcccgcaccucaaccccuuccugagccaccuggcccagauguacaacgggugggucggcaacaugaaggugaaggugcuccuggccgggaacgccuucacggccggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacacccccaccaugcgccuggucugcaugcucuacacgccgcugcgggccuccggcagcuccagcggcaccgaccccuucgugaucgccgggcgcgugcugaccugccccucccccgacuucagcuuccucuuccuggucccgcccaacguggagcagaagaccaagcccuucuccgugcccaaccugccgcucaacacgcugagcaacucccggguccccagccugauccgcuccaugauggugagccgggaccacggccagauggugcaguuccagaacgggcgcgucacccucgacggccagcugcagggcaccacccccacguccgccagccagcugugcaagauccgggggagcguguuccacgccaacggcgggaacggcuacaaccucaccgagcuggacgggucccccuaccacgcguucgagagcccggcccccaucggcuuccccgaccugggcgagugcgacuggcacauggaggccuccccgaccacccaguucgacacgggggacgugaucaagcagaucaacgucaagcaggaggccgccuucgcgccccaccucggcaccauccaggccgacgggcugagcgacguguccgucaacaccaacaugaucgccaagcugggcugggugagccccguguccgacgggcaccgcggcagcgucgaccccugggugaucccgcgguacggcuccacccucacggaggccgcgcagcuggccccgcccaucuacccgcccggguucggcgaggccaucguguucuucaugagcgacuuccccaucgcccacggggccaacggccuguccguccccugcaccaucccccaggaguucgugacccacuucgugaacgagcaggcgcccacccgcggggaggccgcccuccugcacuaccuggaccccgacacgcaccggaaccucggcgaguucaagcuguaccccgagggcuucaugaccugcguccccaacagcuccgggaccggcccgcagacccugcccaucaacgggguguucgccuucgugagcugggucucccgcuucuaccagcucaagcccgugggcacggccggccccgcgcggcgccuguga

SEQ ID NO: 11371 - RNA, 1623 nt, Artificial Sequence
  derived and/or modified sequence opt1 from VP1__Norovirus_and/or_Norovirus-like__AF439267
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacacccccacgaugcgccuggucugcaugcucuacacgccccugcgggccuccggcagcuccagcggcaccgacccguucgugaucgccgggcgcgugcugaccugccccucccccgacuucagcuuccucuuccuggugcccccgaacgucgagcagaagaccaagcccuucuccgugcccaaccugccccucaacacccugagcaacucccgggucccgagccugaucaaguccaugauggugagccgcgaccacggccagauggugcaguuccagaacgggcgggucacccucgacggccagcugcagggcaccacgcccaccuccgccagccagcugugcaagauccgcgggagcguguuccacgccaacggcgggaacggcuacaaccucaccgagcuggacgggucccccuaccacgcguucgagagccccgccccggugggcuuccccgaccugggcgagugcgacuggcacauggaggccucccccaccacgcaguucaacaccggggacgucaucaagcagaucaacgugaagcaggagagcgccuucgccccgcaccucggcaccauccaggcggacgggcuguccgacgucagcgugaacaccaacaugaucgccaagcugggcugggugucccccgucagcgacgggcacaagggcgacguggaccccugggugaucccccgguacggcuccacgcucaccgaggccgcccagcuggcgccgcccaucuacccgcccggguucggcgaggccaucgucuucuucaugagcgacuuccccaucgcccacgggaccaacggccuguccgugcccugcaccaucccccaggaguucgugacgcacuucgucaacgagcaggcccccacccgcggggaggccgcgcuccugcacuaccuggacccggacacccaccggaaccucggcgaguucaagcuguaccccgacggcuucaugaccugcgugcccaacagcuccgggacgggcccccagacccugccgaucaacgggguguucgucuucgugagcugggugucccgcuucuaccagcucaagcccgucggcaccgccggccccgcccggcgccuguga

SEQ ID NO: 11372 - RNA, 1623 nt, Artificial Sequence
  derived and/or modified sequence opt1 from VP1__Norovirus_and/or_Norovirus-like__EF547393
augaugauggccagcaagggcgcccccaccaacauggacgggaccuccggcgcggggcagcuggugccggaggccaacacggccgagcccaucagcauggagcccgucgccggcgccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcuggggccccaccucaacccguuccugagccaccuggcccagauguacaacggcugggucgggaacaugaaggugaaggugcuccuggccggcaacgccuucaccgcggggaagaucaucaucuccugcaucccgcccggcuucgucgcccagaacaucagcaucgcccaggccaccauguucccccacgugaucgccgacgugcgcguccuggagcccaucgaggugccccucgaggacgugcggaacguccuguuccacaacaacgacaacacccccacgaugcgccuggugugcaugcucuacacgccccugcgggcguccggcagcuccagcgggaccgacccguucgugaucgccggccgcguccugaccugccccucccccgacuucagcuuccucuuccuggugcccccgaacguggagcagaagaccaagcccuucuccguccccaaccugccccucaacacccugagcaacucccgggugccgagccugaucaaguccaugauggugagccgcgaccacgggcagaugguccaguuccagaacggccgggugacccucgacggccagcugcaggggaccacgcccaccuccgccagccagcugugcaagauccgcggcagcguguuccacgccaacgggggcaacggguacaaccucaccgagcuggacggcucccccuaccacgccuucgagagccccgcgccgaucggcuuccccgaccugggggagugcgacuggcacauggaggccucccccaccacgcaguucaacaccggcgacgucaucaagcagaucaacgugaagcaggagagcgccuucgccccgcaccucgggaccauccaggccgacggccuguccgacgucagcgugaacaccaacaugaucgcgaagcuggagugggugucccccgucagcgacgggcacaagggcgacguggaccccugggugaucccccgguacggcuccacgcucaccgaggccgcccagcuggccccgcccaucuacccgcccggguucggcgaggcgaucgucuucuucaugagcgacuuccccaucgcccacgggaccaacggccuguccgugcccugcaccaucccccaggaguucgugacgcacuucgucaacgagcaggcccccacccgcggggaggccgcccuccugcacuaccuggacccggacacccaccggaaccucggcgaguucaagcuguaccccgacggcuucaugaccugcgugcccaacagcuccgggacgggcccccagacccugccgaucaacgggguguucgucuucgugagcugggugucccgcuucuaccagcucaagcccgucggcaccgcgggccccgcccggcgccuguga

SEQ ID NO: 11373 - RNA, 1623 nt, Artificial Sequence
  derived and/or modified sequence opt1 from VP1__Norovirus_and/or_Norovirus-like__AF145709
augaugauggccagcaaggacgcgcccccgaacauggacggcaccuccggggccggccagcugauccccgaggccaacaccgccgagcccaucagcauggagcccguggccggggccgcgacggccgccgccaccgcgggccaggucaacaugaucgacccguggaucaugaacaacuacgugcaggcgccccagggggaguucaccaucucccccaacaacacccccggcgacauccucuucgaccugcagcugggcccgcaccucaaccccuuccugagccaccuggcccagauguacaacgggugggugggcaacaugaagaugaagguccuccuggccgggaacgccuucacggccggcaagaucaucaucuccugcaucccgcccggguucgccgcccagaacaucagcaucgcccaggccaccauguucccccacgugaucgcggacgugcgcguccuggagcccaucgaggugccccucgaggacgugcggaacguccuguuccacaacaacgacaacacccccaccaugcgccuggugugcaugcucuacacgccgcugcgggccuccggcagcuccagcggcaccgaccccuucgugaucgccgggcgcguccugaccugccccucccccgacuucagcuuccucuuccuggugccgcccaacguggagcagaagaccaagcccuucuccguccccaaccugccgcucaacacgcugagcaacucccgggugcccagccugaucaaguccaugauggugagccgcgaccacggccagaugguccaguuccagaacgggcgggugacccucgacggccagcugcagggcaccacccccacguccgccagccagcugugcaagauccgcgggagcguguuccacgccaacggcgggaacggcuacaaccucaccgcgcuggacgggucccccuaccacgccuucgagagcccggcccccaucggcuuccccgaccugggcgagugcgacuggcacauggaggccuccccgaccacccaguucgacacgggggacgucaucaagcagaucaacgugaagcaggagagcgccuucgcgccccaccucggcaccauccaggccgacgggcuguccgacgugagcgucaacaccaacaugaucgccaagcugggcugggugucccccgucagcgacgggcaccggggcaacguggaccccugggugaucccgcgcuacggcuccacccucacggaggccgcgcagcuggccccgcccaucuacccgcccggguucggcgaggccaucgucuucuucaugagcgacuucuccaucgcccacgggaccaacggccugagcgugcccugcaccaucccccaggaguucgugacccacuucgucaacgagcaggcccccacgcgcggggaggcggcccuccugcacuaccuggaccccgacacccaccggaaccucggcgaguucaagcuguaccccgagggcuucaugaccugcgugcccaacuccagcgggaccggcccccagacgcugccgaucaacgggguguucgucuucguguccugggugagccgguucuaccagcucaagcccgucggcaccgccggccccgcccgccggcuguga

SEQ ID NO: 11374 - RNA, 1623 nt, Artificial Sequence
  derived and/or modified sequence opt1 from VP1__Norovirus_and/or_Norovirus-like__FJ711163
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacguccucuucgaccugcagcugggcccccaccucaacccguuccugagccaccuggcccagauguacaacgggugggugggcaacaugaaggugaagguccuccuggccgggaacgccuucaccgcgggcaagaucaucaucuccugcaucccgcccggguucgccgcccagaacuucagcaucgcccaggccaccauguucccccacgugaucgcggacgugcgcguccuggagcccaucgaggugccccucgaggacgugcggaacguccuguuccacaacaacgacaacacccccacgaugcgccuggugugcaugcucuacacgccccugcgggccuccggcagcuccagcggcaccgacccguucgugaucgccgggcgcguccugaccugccccucccccgacuucagcuuccucuuccuggugcccccgaacguggagcagaagaccaagcccuucuccguccccaaccugccccucaacacccugagcaacucccgggugccgagccugaucaaguccaugaugaucagccgcgaccacggccagauggugcaguuccagaacgggcgggucacccucgacggccagcugcagggcaccacgcccaccuccgccagccagcugugcaagauccgcgggagcguguuccacgccaacggcgggaacggcuacaaccucaccgagcuggacgggucccccuaccacgcguucgagagccccgccccgaucggcuuccccgaccugggcgagugcgacuggcacauggaggccucccccaucacccaguucgacacgggggacgugaucaagcagaucaacgucaagcaggagagcgccuucgccccgcaccucggcaccgugcaggcggacgggcuguccgacgucagcgccaacaccaacaugaucgccaagcugggcugggugucccccgugagcgacgggcaccgguccgacgucgaccccugggugaucccccgcuacggcagcacccucacggaggccgcgcagcuggccccgcccaucuacccgcccggcuucggggaggccaucguguucuucauguccgacuuccccaucgcccacggcaccaacgggcugagcguccccugcaccaucccccaggaguucgugacccacuucgugaacgagcaggcccccacgcggggcgaggcggcccuccugcacuaccuggacccggacacccaccgcaaccucggggaguucaagcuguaccccgacggcuucaugaccugcguccccaacuccagcggcaccgggccccagacgcugccgaucaacggcguguucguguucgucuccugggugagccgguucuaccagcucaagcccguggggaccgccggccccgcccgccggcuguga

SEQ ID NO: 11375 - RNA, 1623 nt, Artificial Sequence
  derived and/or modified sequence opt1 from VP1__Norovirus_and/or_Norovirus-like__FJ711164
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacguccucuucgaccugcagcugggcccccaccucaacccguuccugagccaccuggcccagauguacaacgggugggugggcaacaugaaggugaagguccuccuggccgggaacgccuucaccgcgggcaagaucaucaucuccugcaucccgcccggguucguggcccagaacuucagcaucgcccaggccaccauguucccccacgugaucgccgacguccgcgugcuggagcccaucgaggugccccucgaggacguccggaacgugcuguuccacaacaacgacaacacccccacgaugcgccuggugugcaugcucuacacgccccugcgggcgggcggcuccagcuccgggaccgacccguucgucaucgccggccgcgugcugaccugccccagccccgacuucuccuuccucuuccuggugcccccgaacgucgagcagaagaccaagcccuucagcgugcccaaccugccccucaacacccuguccaacagccgggugccgucccugaucaagagcaugaugaucucccgcgaccacgggcagaugguccaguuccagaacggccgggugacccucgacggccagcugcaggggaccacgcccaccagcgccucccagcugugcaagauccgcggcagcguguuccacgccaacgggggcaacggguacaaccucaccgagcuggacggcagccccuaccacgccuucgagucccccgcgccgaucggcuuccccgaccugggggagugcgacuggcacauggaggccagccccaccacgcaguucgacaccggcgacgucaucaagcagaucaacgugaagcaggaguccgccuucgccccgcaccucgggaccguccaggccgacggccugagcgacguguccgcgaacaccaacaugaucgccaagcuggggugggugagccccgucuccgacggccaccggagcgacguggaccccugggugaucccccgcuacggcuccacgcucaccgaggccgcccagcuggcgccgcccaucuacccgcccggguucggcgaggccaucgucuucuucaugagcgacuuccccaucgcccacgggaccaacggccuguccgugcccugcaccaucccccaggaguucgugacgcacuucgucaacgagcaggcccccacccgcggggaggccgcgcuccugcacuaccuggacccggacacccaccggaaccucggcgaguucaagcuguaccccgacggcuucaugaccugcgugcccaacagcuccgggacgggcccccagacccugccgaucaacgggguguucgucuucgugagcugggugucccgguucuaccagcucaagcccgucggcaccgccggccccgcccgccggcuguga

SEQ ID NO: 11376 - RNA, 1623 nt, Artificial Sequence
  derived and/or modified sequence opt1 from VP1__Norovirus_and/or_Norovirus-like__AF414405
augaugauggccagcaaggacgcgcccccgaacauggacggcaccuccggggcgggccagcuggugcccgaggccaacaccgccgagcccaucagcauggagcccgucgccggggccgcgacggccgccgccaccgcgggccaggugaacaugaucgacccguggaucaugaacaacuacgugcaggcgccccagggggaguucaccaucucccccaacaacacccccggcgacauccucuucgaccugcagcugggcccgcaccucaaccccuuccugagccaccuggcccagauguacaacgggugggucggcaacaugaaggugaaggugcuccuggccgggaacgccuucacggccggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacacccccaccaugcgccuggucugcaugcucuacacgccgcugcgggccuccggcagcuccagcggcaccgaccccuucgugaucgccgggcgcgugcugaccugccccucccccgacuucagcuuccucuuccuggucccgcccaacguggagcagaagaccaagcccuucuccgugcccaaccugccgcucaacacgcugagcaacucccggguccccagccugaucaaguccaugauggugagccgcgaccacggccagauggugcaguuccagaacgggcgggucacccucgacggccagcugcagggcaccacccccacguccgccagccagcugugcaagauccgcgggagcguguuccacgccaacggcgggaacggcuacaaccucaccgagcuggacgggucccccuaccacgcguucgagagcccggcccccaucggcuuccccgaccugggcgagugcgacuggcacauggaggccuccccgaccacccaguucgacacgggggacgugaucaagcagaucaacgucaagcaggagagcgccuucgcgccccaccucggcaccauccaggccgggggccuguccgacgugagcgucaacaccaacaugaucgccaagcuggggugggugucccccgugagcgacggccaccggggcaacgucgaccccugggugaucccgcgcuacggguccacccucacggaggccgcccagcuggccccgcccaucuacccgcccggcuucggggaggccaucguguucuucaugagcgacuuccccaucgcccacggcaccaacgggcuguccguccccuucaccaucccccaggaguucgugacccacuucgugaacgagcaggcccccacgcggggcgaggccgcgcuccuguacuaccuggaccccgacacccaccgcaaccucggcgaguucaagcuguaccccgagggguucaugaccugcguccccaacagcuccggcaccgggccgcagacgcugcccaucaacggcguguucguguucgucagcugggugucccgguucuaccagcucaagcccgugggcaccgccgggcccgcccgccggcuguga

SEQ ID NO: 11377 - RNA, 1623 nt, Artificial Sequence
  derived and/or modified sequence opt1 from VP1__Norovirus_and/or_Norovirus-like__AB022679
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucaugggcuucggggcccccgccccggcgggcuuccccgaccugggguccugcgacuggcacaucgagaugagcaagauccccaacagcuccacgcagaacaaccccaucgugaccaacagcgugaagccgaacucccagcaguucgucccccaccucagcuccaucacccuggacgagaacgugagcuccggcggggacuacaucggcaccauccaguggacgagcccgcccuccgacagcggcggggccaacaccaacuucuggaagauccccgacuacggcuccagccuggccgaggccucccagcucgcccccgcgguguacccgcccggguucaacgaggucaucguguacuucauggccagcauccccggccccaaccaguccgggagccccaaccuggugcccugccugcucccgcaggaguacaucacccacuucaucuccgagcaggcccccauccagggcgaggccgcccugcugcacuacgucgaccccgacaccaaccgcaaccucggcgaguucaagcuguaccccgggggcuaccugacgugcgugccgaacagcuccagcaccgggccccagcagcucccccuggacggcguguucgucuucgcgagcugggugucccgguucuaccagcugaagcccgugggcaccgccgggccggcccgcggccggcucuga

SEQ ID NO: 11378 - RNA, 1623 nt, Artificial Sequence
  derived and/or modified sequence opt1 from VP1__Norovirus_and/or_Norovirus-like__AF414403
augaugauggccagcaaggacgcgcccccgaacauggacggcaccuccggggccggccagcuggugcccgaggccaacaccgccgagcccaucagcauggagcccgucgccggggccgcgacggccgccgccaccgcgggccaggugaacaugaucgacccguggaucaugaacaacuacgugcaggcgccccagggggaguucaccaucucccccaacaacacccccggcgacauccucuucgaccugcagcugggcccgcaccucaaccccuuccugagccaccuggcccagauguacaacgggugggucggcaacaugaaggugaaggugcuccuggccgggaacgccuucacggccggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacacccccaccaugcgccuggucugcaugcucuacacgccgcugcgggccuccggcagcuccagcggcaccgaccccuucgugaucgccgggcgcgugcugaccugccccucccccgacuucagccuccuguuccuggucccgcccaacguggagcagaagaccaagcccuucuccgugcccaaccucccgcugaacacgcugagcaacucccggguccccagccucaucaaguccaugauggugagccgcgaccacggccagauggugcaguuccagaacgggcgggucgcccuggacggccagcugcagggcaccacccccaccuccgccagccagcucugcaagauccgcgggagcguguuccacgcgaacggcgggaacggcuacaaccccacggagcuggacggguccccguaccacgccuucgagagccccgcccccaucggcuucccggaccugggcgagugcgacuggcacauggaggccucccccaccacccaguucgacaccggggacgugaucaagcagaucaacgucaagcaggagagcgccuucgcgccccaccucggcacgauccaggccgacgggcuguccgacgugagcgucaacaccaacaugaucgccaagcugggcugggugucccccgugagcgacgggcaccggggcaacgucgacccgugggugaucccccgcuacggcuccacccucaccgaggccgcgcagcuggccccgcccaucuacccgcccggguucggcgaggccaucguguucuucaugagcgacuuccccaucgcccacgggacgaacggccuguccguccccugcaccaucccccaggaguucgugacccacuucgugaacgagcaggcccccacccgcggggaggcggcccuccugcacuaccuggaccccgacacgcaccggaaccucggcgaguucaagcuguaccccgagggcuucaugaccugcgucccgaacagcuccgggaccggcccccagacccugcccaucaacgggguguucguguucgucagcugggugucccgguucuaccagcucaagcccgugggcacggccggcccggcccgccggcuguga

SEQ ID NO: 11379 - RNA, 1623 nt, Artificial Sequence
  derived and/or modified sequence opt1 from VP1__Norovirus_and/or_Norovirus-like__LC101821
augaugauggccagcaaggacgccgcgcccuccgccgacggcgccaccggggccggccagcuggugccggaggucaacaccgccgaccccauccccaucgaccccguggcggggagcuccacggcccucgccaccgccggccaggugaaccugaucgacccguggaucaucaacaacuucguccaggcgccccagggggaguucaccaucagccccaacaacacccccggcgacgugcuguucgaccuccagcugggcccgcaccugaaccccuuccucucccaccugagccagauguacaacgggugggugggcaacaugcgcguccggguggugcuggccgggaacgccuucacggccggcaaggucaucaucugcugcgugccgcccggguuccagucccgcacccucagcaucgcccaggcgacccuguucccccacgugaucgccgacguccggacccuggaccccguggaggugccccucgaggacguccgcaacgugcuguaccacaacaacgacacgcagcccaccaugcggcugcucugcaugcuguacaccccgcugcgcaccggcggcgccuccgggggcacggacagcuucguggucgccgggcgggugcugaccugccccggccccgacuucaacuuccucuuccuggugcccccgaccgucgagcagaagacccgccccuucacggugcccaacaucccccucaaguaccuguccaacagccggaucccgaaccccaucgagggcaugucccugagccccgaccagacccagaacgugcaguuccagaacgggcgcugcaccaucgacggccagccccucgggaccacgccggucuccgugagccagcugugcaaguuccggggccgcaucaccuccgggcagaagguccugaaccucaccgagcuggacggcagccccuucauggccuucgcggcccccgccccggugggcuuccccgaccugggguccugcgacuggcacaucgagaugagcaagauccccaacagcuccacccagagcaaccccaucguggucaacuccgugaagccgaacagccagcaguucgugccccaccucuccagcaucacgcuggacgacaacgucuccagcggcggggacuacaucggcaccauccaguggaccuccccgcccagcggguccggcggcgccaacaccaacuucuggaagauccccgacuacgggagcucccuggccgaggcgagccagcucgcccccgccguguacccgcccggcuucaacgaggugaucgucuacuucauggccuccauccccgggcccaaccagagcggcucccccaaccuggugcccugccugcucccgcaggaguacaucacgcacuucaucagcgagcaggcccccauccagggggaggcggcccugcugcacuacguggaccccgacaccaaccggaaccucggcgaguucaagcuguaccccggcggguaccugaccugcgucccgaacuccagcagcaccggcccccagcagcucccccuggacgggguguucguguucgccuccugggucagccgcuucuaccagcugaagcccgugggcacggccggcccggcgcgggggcgccucuga

SEQ ID NO: 11380 - RNA, 1623 nt, Artificial Sequence
  derived and/or modified sequence opt1 from VP1__Norovirus_and/or_Norovirus-like__AY038598
augaugauggccagcaaggacgcgcccccgaacauggacggcaccuccggggccggccagcuggugcccgaggccaacaccgccgagcccaucagcauggagcccgucgccggggccgcgacggccgccgccaccgcgggccaggugaacaugaucgacccguggaucauggacaacuacgugcaggcgccccagggggaguucaccaucucccccaacaacacccccggcgacauccucuucgaccugcagcugggcccgcaccucaaccccuuccugagccaccuggcccagauguacaacgggugggucggcaacaugaaggugaaggugcuccuggccgggaacgccuucacggccggcaagaucaucaucuccugcaucccgcccggguucgccgcccagaacaucagcaucgcccaggccaccauguucccccacgucaucgcggacgugcgcgugcuggaccccaucgaggucccccucgaggacgugggcaacgugcuguuccacaacaacggcgacacccccaccaugcggcuggucugcaugcucuacacgccgcugcgcgccuccgggagcuccagcggcaccgaccccuucgugaucgccgggcacgugcugaccugccccucccccgacuucagcuuccucuuccugggcccgcccaacgucgagcagaagaccaagcccuucuccgugcccaaccugccgcucaacacgcugagcaacucccgggugcccagccugauccgcuccaugauggucagccgggaccacggccagauggugcaguuccagaacgggcgcgugacccucgacggccagcugcaggggaccacccccacguccgccagccagcugugcaagauccggggcagcgucuuccacgccaacgggggcaacggcuacacccucaccgagcuggacgggucccccuaccacgcguucgagagcccggcccccaucggcuuccccgaccugggggagugcgacuggcacauggaggccuccccgaccacgcaguucgacaccggcgacgugaucaagcagaucaacgugaagcaggaggccgccuucgcgccccaccucgggaccauccaggccgacggccugagcgacgucuccgugaacaccaacaugaucgccaagcugggcugggucagccccgccuccgacgggcaccgcggcaacguggaccccugggugaucccgcgguacgggagcacgcucaccgaggcggcccagcuggccccgcccaucuacccgcccggcuucggggaggccaucgucuucuucauguccgacuuccccaucgcccacggcgcgaacggccugagcgugcccugcaccaucccccaggaguucgugacccacuucgucaacgagcaggcccccacgcgcggggaggccgcccuccugcacuaccuggaccccgacacccaccggaaccucggcgaguucaagcuguaccccgagggguucaugaccugcgugcccaacuccagcggcaccggcccgcagacgcugcccaucaacgggguguucgucuucguguccugggugagccgcuucuaccagcucaagcccgucggcaccgccgggcccgcgcggucccuguga

SEQ ID NO: 11381 - RNA, 1623 nt, Artificial Sequence
  derived and/or modified sequence opt1 from VP1__Norovirus_and/or_Norovirus-like__KJ196292
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgucgcccagaacgugagcaucgcccaggccaccauguucccccacgugaucgccgacguccgcgugcuggagcccaucgaggugccccucgaggacguccggaacgugcuguuccacaacaacgacaacacccccacgaugcgccuggugugcaugcucuacacgccccugcgggcguccggcagcuccagcggcaccgacccguucgucaucgccgggcgcgugcugaccugccccucccccgacuucagcuuccucuuccuggugcccccgaacgucgagcagaagaccaagcccuucuccgugcccaaccugccccucaacacccugagcaacucccgggugccgagccugaucaaguccaugauggucagccgcgaccacggccagauggugcaguuccagaacgggcgggugacccucgacggccagcugcagggcaccacgcccaccuccgccagccagcugugcaagauccgcgggagcgucuuccacgccaacggcgggaacggcuacaaccucaccgagcuggacgggucccccuaccacgccuucgagagccccgcgccgaucggcuuccccgaccugggcgagugcgacuggcacauggaggccucccccaccacgcaguucaacaccggggacgugaucaagcagaucaacgucaagcaggagagcgccuucgccccgcaccucggcaccauccaggccgacgggcuguccgacgugagcgugaacaccaacaugaucgcgaagcugggcugggucucccccgugagcgacgggcacaagggcgacguggaccccugggucaucccccgguacggcuccacgcucaccgaggccgcccagcuggccccgcccaucuacccgcccggguucggcgaggcgaucguguucuucaugagcgacuuccccaucgcccacgggaccaacggccuguccgugcccugcaccaucccccaggaguucgucacgcacuucgugaacgagcaggcccccacccgcggggaggccgcccuccugcacuaccuggacccggacacccaccggaaccucggcgaguucaagcuguaccccgacggcuucaugaccugcgugcccaacagcuccgggacgggcccccagacccugccgaucaacggggucuucguguucgugagcugggucucccgcuucuaccagcucaagcccgugggcaccgcgggccccgcccggcgccuguga

SEQ ID NO: 11382 - RNA, 1623 nt, Artificial Sequence
  derived and/or modified sequence opt1 from VP1__Norovirus_and/or_Norovirus-like__JQ743331
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgagaugagcaagauccccaacagcuccacgcagagcaaccccaucguggugaacuccgucaagccgaacagccagcaguucgugccccaccucuccagcaucacccuggacgacaacguguccagcggcggggacuacaucggcaccauccaguggaccuccccgcccagcgacuccgggggcgccaacacgaacuucuggaagauccccgacuacggcagcucccuggccgaggcgagccagcucgcccccgccgucuacccgcccggguucaacgaggugaucguguacuucauggccuccauccccggccccaaccagagcgggucccccaaccugguccccugccugcucccgcaggaguacaucacccacuucaucagcgagcaggcccccauccagggcgaggcggcccugcugcacuacguggaccccgacaccaaccggaaccucggggaguucaagcuguaccccggcggcuaccugaccugcgugccgaacuccagcagcacggggccccagcagcucccccuggacggcgucuucguguucgccuccugggugagccgcuucuaccagcugaagcccgucgggaccgccggcccggcgcggggccgccucuga

SEQ ID NO: 11383 - RNA, 1623 nt, Artificial Sequence
  derived and/or modified sequence opt1 from VP1__Norovirus_and/or_Norovirus-like__EF547394
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgaggugagcaagauccccaacagcuccacgcagagcaaccccaucguggucaacuccgugaagccgaacagccagcaguucgugccccaccucuccagcaucacccuggacgacaacgucuccagcggcggggacuacaucggcaccauccaguggaccuccccgcccagcgacuccgggggcgccaacacgaacuucuggaagauccccgacuacggcagcucccuggccgaggcgagccagcucgcccccgccguguacccgcccggguucaacgaggugaucgucuacuucauggccuccauccccggccccaaccagagcgggucccccaaccuggugcccugccugcucccgcaggaguacaucacccacuucaucagcgagcaggcccccauccagggcgaggcggcccugcugcacuacguggaccccgacaccaaccggaaccucggggaguucaagcuguaccccggcggcuaccugaccugcgucccgaacuccagcagcacggggccccagcagcucccccuggacggcguguucguguucgccuccugggucagccgcuucuaccagcugaagcccguggggaccgccggcccggcgcggggccgccucuga

SEQ ID NO: 11384 - RNA, 1623 nt, Artificial Sequence
  derived and/or modified sequence opt1 from VP1__Norovirus_and/or_Norovirus-like__AF394960
augaugauggccagcaaggacgccacccccuccgcggacggcgccaccggggccggccagcuggugccggaggucaacacggccgggcccauccccaucgaccccguggccggcagcuccaccgcgcucgccaccgccggccaggugaaccugaucgacccguggaucaucaacaacuucguccaggcgccccagggggaguucaccaucagccccaacaacacgcccggcgacgugcuguucgaccuccagcuggggccgcaccugaaccccuuccucucccaccugagccagauguacaacggcuggguggggaacaugcgcguccggguggugcuggccggcaacgccuucaccgccgggaaggucaucaucugcugcgugccgcccggcuuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggggccuccggcgggaccgacagcuucguggucgccggccgggugcugaccugccccggccccgacuucaacuuccucuuccuggugcccccgaccgucgagcagaagacgcgccccuucaccgugcccaacaucccccucaaguaccuguccaacagccggaucccgaaccccaucgaggggaugucccugagccccgaccagacccagaacgugcaguuccagaacggccgcugcaccaucgacgggcagccccucggcacgaccccggucuccgugagccagcugugcaaguuccgggggcgcaucaccuccggccagaagguccugaaccucaccgagcuggacggcagccccuucauggccuucgccgcgcccgccccggccggguuccccgaccugggcuccugcgacuggcacaucgagaugagcaagauccccaacagcuccacgcagagcaaccccaucguggugaacuccgucaagccgaacagccagcaguucgugccccaccucuccagcaucacccuggacgacaacguguccagcgggggcgacuacaucgggaccauccaguggaccuccccgcccagcgacuccggcggcgccaacacgaacuucuggaagauccccgacuacgggagcucccuggccgaggcgagccagcucgcccccgccgucuacccgcccggcuucaacgaggugaucguguacuucauggccuccauccccgggcccaaccagagcggcucccccaaccugguccccugccugcucccgcaggaguacaucacccacuucaucagcgagcaggcccccauccagggggaggcggcccugcugcacuacguggaccccgacaccaaccggaaccucggcgaguucaagcuguaccccggcggguaccugaccugcgugccgaacuccagcagcacgggcccccagcagcucccccuggacggggucuucguguucgccuccugggugagccgcuucuaccagcugaagcccgucggcaccgccggcccggcgcgggggcgccucuga

SEQ ID NO: 11385 - RNA, 1623 nt, Artificial Sequence
  derived and/or modified sequence opt1 from VP1__Norovirus_and/or_Norovirus-like__AJ277616
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccaagcuggacggcagccccuucauggccuucgccgcgcccgccccggccggcuuccccaaccugggguccugcgacuggcacaucgagaugagcaagauccccaacagcuccacgcagagcaaccccaucguggugaacuccgucaagccgaacagccagcaguucgugccccaccucuccagcaucacccuggacgagaacguguccagcggcggggacuacaucggcaccauccaguggaccuccccgcccagcgacuccgggggcgccaacacgaacuucuggaagauccccgacuacggcagcucccuggccgaggcgagccagcucgcccccgccgucuacccccugguguucaacgaggugaucgucuacuucauggccugcauccgggggcccaaccagugcggcuccccgaaccuggugcccugccucagcccccaggaguacaucacccacuucaucuccgagcaggcccccauccagggggaggcggcccugcugcacuacguggacccggacaccaaccgcaaccucggcgaguucaagcuguaccccgggggcuaccugaccugcguccccaacagcuccagcacgggcccccagcagcucccgcuggacgggguguucguguucgccagcugggucucccgguucuaccagcugaagcccgugggcaccgccgggcccgcgcgcggccggcucuga

SEQ ID NO: 11386 - RNA, 1623 nt, Artificial Sequence
  derived and/or modified sequence opt1 from VP1__Norovirus_and/or_Norovirus-like__GQ413970
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucauggccuucgccgcgcccgccccggccggcuuccccgaccugggguccugcgacuggcacaucgagaugagcaagauccccaacagcuccacgcagaacaaccccaucguggugaacagcgucaagccgaacucccagcaguucgugccccaccucagcuccaucacccuggacgacaacgugagcuccggcggggacuacaucggcaccauccaguggaccagcccgcccuccgacagcgggggcgccaacacgaacuucuggaagauccccgacuacggcuccagccuggccgaggcgucccagcucgcccccgccgucuacccgcccggguucaacgaggugaucguguacuucauggccagcauccccggccccaaccaguccgggagccccaaccugguccccugccugcucccgcaggaguacaucacccacuucaucuccgagcaggcccccauccagggcgaggcggcccugcugcacuacguggaccccgacaccaaccgcaaccucggggaguucaagcuguaccccggcggcuaccugaccugcgugccgaacagcuccagcacggggccccagcagcucccccuggacggcgucuucguguucgccagcugggugucccgguucuaccagcugaagcccgucgggaccgccggcccggcgcgcggccggcucuga

SEQ ID NO: 11387 - RNA, 1623 nt, Artificial Sequence
  derived and/or modified sequence opt1 from VP1__Norovirus_and/or_Norovirus-like__KT732281
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgaggugagcaagauccccaacagcuccacgcagggcaaccccaucguggucaacagcgugaagccgaacucccagcaguucgugccccaccucagcuccaucacccuggacgacaacgucagcuccgggggcgacuacaucgggaccauccaguggaccagcccgcccuccgacagcggcggcgccaacacgaacuucuggaagauccccgacuacggguccagccuggccgaggcgucccagcucgcccccgccguguacccgcccggcuucaacgaggugaucgucuacuucauggccagcauccccgggcccaaccaguccggcagccccaaccuggugcccugccugcucccgcaggaguacaucacccacuucaucuccgagcaggcccccauccagggggaggcggcccugcugcacuacguggaccccgacaccaaccggaaccucggcgaguucaagcuguaccccggcggguaccugaccugcgucccgaacagcuccagcacgggcccccagcagcucccccuggacgggguguucguguucgccagcugggucucccgcuucuaccagcugaagcccgugggcaccgccggcccggcgcgggggcgccucuga

SEQ ID NO: 11388 - RNA, 1623 nt, Artificial Sequence
  derived and/or modified sequence opt1 from VP1__Norovirus_and/or_Norovirus-like__AF414404
augaugauggccagcaaggacgccacccccuccgcggacggcgccaccggggccggccagcuggugccggaggucaacacggccgaccccauccccaucgaccccguggccgggagcuccaccgcgcucgccaccgccggccgcgugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcggguccgcguggugcuggccgggaacgccuucaccgccggcaaggucaucaucugcugcgugccgcccggguuccagucccggacccucagcaucgcccaggccacccuguucccccacgugaucgcggacguccgcacgcuggaccccguggaggugccccucgaggacguccggaacgugcugcaccacaacaacgacacccagcccaccaugcgccugcucugcaugcuguacaccccgcugcggacgggcggcgccuccgggggcaccgacagcuucguggucuccgggcgcgugcugaccugccccggccccgacuucaacuuccucuuccuggugcccccgaccgucgagcagaagacgcggcccuucaccgugcccaacaucccccucaagugccugagcaacucccgcaucccgaaccccaucgagggcaugagccugucccccgaccagacccagaacgugcaguuccagaacgggcggugcaccaucgacggccagccccucgggacgaccccggucagcgugucccagcugugcaaguuccgcggccggaucaccagcgggcagggcguccugaaccucaccgagcuggacggcucccccuucauggccuucgccgcccccgcgccggccggguuccccgaccugggcagcugcgacuggcacaucgagaugagcaagauccccaacuccagcacgcagaacaaccccaucguggugaacuccgucaagccgaacagccagcaguucgugccccaccucuccagcaucacccuggacgagaacguguccagcgggggcgacuacaucgggaccauccaguggaccuccccgcccagcgacuccggcggcgccaacacgaacuucuggaagauccccgacuacgggagcucccuggccgaggccagccagcucgcgcccgccgucuacccgcccggcuucaacgaggugaucguguacuucauggccuccauccccgggcccaaccagagcggcucccccaaccugguccccugccugcucccgcaggaguacaucacccacuucaucagcgagcaggcccccauccagggggaggccgcgcugcugcacuacguggaccccgacaccaaccgcaaccucggcgaguucaagcuguaccccggcggguaccugaccugcgugccgaacuccagcagcacgggcccccagcagcucccccuggacggggucuucguguucgccuccugggugagccgguucuaccagcugaagcccgucggcaccgccggcccggcccgcgggcggcucuga

SEQ ID NO: 11389 - RNA, 1623 nt, Artificial Sequence
  derived and/or modified sequence opt1 from VP1__Norovirus_and/or_Norovirus-like__AF414402
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugccgcgugccgcccggguuccagucccggacccucagcaucgcccaggccacccuguucccccacgugaucgcggacguccgcacgcuggaccccguggaggugccccucgaggacguccggaacgugcuguaccacaacaacgacacccagcccaccaugcgccugcucugcaugcuguacaccccgcugcggacgggcggcgccuccgggggcaccgacagcuucguggucguggggcgcgugcugaccugccccggccccgacuucaacuuccucuuccuggugcccccgaccgucgagcagaagacgcggcccuucaccgcccccaacaucccccucaaguaccuguccaacagccgcaucccgaaccccaucgagggcaugucccugagccccgaccagacccagaacgugcaguuccagaacgggcggugcaccaucgacggccagccccucggggccacgccggucuccgugagccagcugugcaaguuccgcggccggaucaccuccgggcagcgcgcccugaaccucaccgagcuggacggcagccccuucauggcguucgccgcccccgccccggccggcuuccccgaccugggguccugcgacuggcacaucgagaugagcaagauccccaacagcuccacccagaacaaccccaucgucgugaacagcgugaagccgaacucccagcaguucgucccccaccuccccagcaucacgcuggacgagaacguguccagcggcggggacuacaucggcaccauccaguggaccuccccgcccagcgacuccgggggcgcgaacaccaacuucuggaagauccccgacuacggcagcucccuggccgaggccagccagcucgcccccgccguguacccgcccggguucaacgaggucaucguguacuucauggcguccauccccggccccaaccagagcgggucccccaaccuggugccgugccugcucccccaggaguacaucacgcacuucaucagcgagcaggcccccauccagggcgaggccgcccugcugcacuacgucgaccccgacaccaaccggaaccucggggaguucaagcuguacccgggcggcuaccugaccugcgugcccaacuccagcuccaccgggccccagcagcucccccuggacggcguguucgucuucgcgagcugggugagccgcuucuaccagcugaagccgguggggacggccggccccgcccggggccgccucuga

SEQ ID NO: 11390 - RNA, 1623 nt, Artificial Sequence
  derived and/or modified sequence opt1 from VP1__Norovirus_and/or_Norovirus-like__AJ313030
augaugauggccagcaaggacgccacccccuccgcggacggcgcccugggggccggccagcucgugccggaggucaacaccgccgaccccauccccaucgaccccguggccgggagcuccacggcgcuggccaccgccggccaggugaaccugaucgacccguggaucaucaacaacuucguccaggcgccccagggggaguucaccaucagccccaacaacacccccggcgacguccucuucgaccugcagcugggcccgcaccucaaccccuuccugucccaccugagccagauguacaacgggugggugggcaacaugcgcgugcggguggugcucgccgggaacgccuucacggccggcaaggucaucaucugcugcgugccgcccggguuccagucccgcacccugagcaucgcccaggccacccuguucccccacgugaucgcggacguccggacccucgaccccguggaggugccccuggaggacguccgcaacgugcuguaccacaacaacgacacgcagcccaccaugcggcuccugugcaugcuguacaccccgcuccgcaccggcggcgccuccgggggcacggacagcuucguggucgccgggcgggugcugaccugccccggccccgacuucaacuuccuguuccucgugcccccgaccgucgagcagaagacccgccccuucacggugcccaacaucccccugaaguaccuguccaacagccggaucccgaaccccaucgagggcaugucccucagccccgaccagacccagaacgugcaguuccaguccgggcgcugcaccaucgacggccagccccuggggaccacgccggucagcgugucccagcugugcaaguuccggggccgcaucaccagcgggcagaagguccucaaccugaccggccuggacggcucccccuucauggccuucgccgcgcccgccccggccggguuccccgaccucggcagcugcgacuggcacaucgagaugagcaagauccccaacuccagcacccagaacaaccccaucgugaucaacuccgugaagccgaacagccagcaguucgucccccaccuguccagcaucacgcuggacgagaacgugcucuccgggggcgacuacaucgggaccauccaguggaccagcccgcccuccgacagcggcggcgccaacaccaacuucuggaagauccccgacuacggguccagccuggccgaggcgucccagcuggcccccgccguguacccgcccggcuucaacgaggucaucguguacuucauggccagcauccccgggcccaaccaguccggcagccccaaccucgugcccugccugcugccgcaggaguacaucacgcacuucaucuccgagcaggcccccauccagggggaggcggcccuccugcacuacgucgaccccgacaccaaccggaaccugggcgaguucaagcucuaccccggcggguaccugaccugcgugccgaacagcuccagcaccggcccccagcagcugccccucgacgggguguucgucuucgccagcugggugucccgcuucuaccagcugaagcccgugggcacgcggggcccggcccgcgggcggcuguga

SEQ ID NO: 11391 - RNA, 1623 nt, Artificial Sequence
  derived and/or modified sequence opt1 from VP1__Norovirus_and/or_Norovirus-like__KM036381
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgagaugagcaagauccccaacagcuccacggagagcaaccccaucguggugaacuccgucaagccgaacagccagcaguucgugccccaccucuccagcaucacccuggacgacaacguguccagcggcggggacuacaucggcaccauccaguggaccuccccgcccagcgacuccgggggcgccaacacgaacuucuggaagauccccaacuacggcagcucccuggccgaggcgagccagcucgcccccgccgucuacccgcccggguucaacgaggugaucguguacuucauggccuccauccccggccccaaccagagcgggucccccaaccugguccccugccugcucccgcaggaguacaucacccacuucaucagcgagcaggcccccauccagggcgaggcggcccugcugcacuacguggaccccgacaccaaccggaaccucggggaguucaagcuguaccccggcggcuaccugaccugcgugccgaacuccagcagcacggggccccagcagcucccccuggacggcgucuucguguucgccuccugggugagccgcuucuaccagcugaagcccgucgggaccgccggcccggcgcggggccgccucuga

SEQ ID NO: 11392 - RNA, 1623 nt, Artificial Sequence
  derived and/or modified sequence opt1 from VP1__Norovirus_and/or_Norovirus-like__LN854563
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucauggccuucgccgcgcccgccccggccggcuuccccgaccugggguccugcgacuggcacaucgagaugagcaagauccccaacagcuccacgcagaacaaccccaucguggugaacagcgucaagccgaacucccagcaguucgugccccaccucagcuccaucacccuggacgacaucgugagcuccggcggggacuacaucggcaccauccaguggaccagcccgcccuccgacagcgggggcgccaacacgaacuucuggaagauccccgacuacggcuccagccuguccgaggccagccagcucgcgcccgccgucuacccgcccggguucaacgaggugaucguguacuucauggccuccauccccggccccaaccagagcgggucccccaaccugguccccugccugcucccgcaggaguacaucacccacuucaucagcgagcaggcccccauccagggcgaggccgcgcugcugcacuacguggaccccgacaccaaccgcaaccucggggaguucaagcuguaccccggcggcuaccugaccugcgugccgaacuccagcagcacggggccccagcagcucccccuggacggcgucuucguguucgccuccugggugagccgguucuaccagcugaagcccgucgggaccgccggcccggcccgcggccggcucuga

SEQ ID NO: 11393 - RNA, 1623 nt, Artificial Sequence
  derived and/or modified sequence opt1 from VP1__Norovirus_and/or_Norovirus-like__AB042808
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucauggccuucgccgcgcccgccccggccggcuuccccgaccugggguccugcgacuggcacaucgagaugagcaagauccccaacagcuccacgcagaacaaccccaucgugaccaacagcgugaagccgaacucccagcaguucgucccccaccucagcuccaucacccuggacgagaacgugagcuccggcggggacuacaucggcaccauccaguggacgagcccgcccuccgacagcgggggcgccaacaccaacuucuggaagauccccgacuacggcuccagccuggccgaggcgucccagcucgcccccgccguguacccgcccggguucaacgaggucaucguguacuucauggccagcauccccggccccaaccaguccgggagccccaaccuggugcccugccugcucccgcaggaguacaucacccacuucaucuccgagcaggcccccauccagggcgaggcggcccugcugcacuacgucgaccccgacaccaaccgcaaccucggggaguucaagcuguaccccggcggcuaccugacgugcgugccgaacagcuccagcaccgggccccagcagcucccccuggacggcguguucgucuucgccagcugggugucccgguucuaccagcugaagcccguggggaccgccggcccggcgcgcggccggcucuga

SEQ ID NO: 11394 - RNA, 1623 nt, Artificial Sequence
  derived and/or modified sequence opt1 from VP1__Norovirus_and/or_Norovirus-like__EU004679
augcgcaugagcgacggcgccgcccccaaggccaacggguccgaggccagcggccaggaccuggugccgaccgccaucgagcaggccguccccauccagcccguggccggguccgcgcucgccgcccccgccgcgggccagaucaaccagaucgacccguggaucuuccagaacuucgugcagugcccccugggggaguucagcaucagcccccggaacacccccggcgagauccuguucgaccucgcccugggcccggggcugaaccccuaccucgcccaccuguccgccauguacacgggcugggucgggaacauggaggugcagcuggugcucgccggcaacgcguucaccgccgggaaggucgugguggcccuggucccgcccuacuuccccaagggcucccugaccaccgcccagaucacgugcuucccccacgugaugugcgacgugcgcacccucgagcccauccagcugccccugcucgacguccggcgcgugcuguggcacgccacccaggaccaggaggagagcaugcggcuggugugcaugcucuacaccccgcugcgcacgaacucccccggcgacgagagcuucgucguguccgggcggcugcucagcaagcccgcggccgacuucaacuucguguaccugacgcccccgaucgagcgcaccaucuaccggauggucgaccugcccgugcuccagccccgccugugcacccacgcccgguggcccgccccgaucuacggccugcucguggaccccucccugcccagcaacccccaguggcagaacgggcgcguccacguggacggcacccugcucggcaccaccccgguguccgggagcugggucuccugcuucgccgcggaggccgccuacgaguuccagagcggcaccggggagguggccacguucacccugaucgagcaggacggcuccgccuacguccccggggaccgggcggcgccccugggcuacccggacuucagcggccagcucgagaucgaggugcagaccgagaccacgaagaccggggacaagcugaaggugaccaccuucgagaugauccugggccccacgaccaacgucgaccaggcccccuaccaggggaagguguacgccagccucgccguggccgccucccuggaccuggucgacggccgcgugcgggccgugccccgcagcaucuacggguuccaggacgucaucccggaguacaacgacggccuccuggugccccuggccccgcccaucggccccuuccuccccggggagauccugcugcgguuccgcaccuacaugcggcagcucgacaccgcggacgccgccgccgaggccaucgacugcgcgcugccccaggaguucaucuccugguucgccagcaacgccuucacggugcaggccgacgcccugcuccugcgcuaccggaacacccugaccggccagcuccuguucgagugcaagcuguacuccgagggguacaucgcgcugagcuacuccggcagcgcgccccucaccuucccgacggacggguucuucgaggucguguccugggugccccgccuguuccagcuggccagcgucggcucccucaccaccggccgcacccugaaguga

SEQ ID NO: 11395 - RNA, 1623 nt, Artificial Sequence
  derived and/or modified sequence opt1 from VP1__Norovirus_and/or_Norovirus-like__EU004678
augcgcaugagcgacggcgccgcccccaaggcgaacggguccgaggccagcggccaggaccuggugccgaccgccgucgagcaggccgugcccauccagcccguggccggguccgcgcucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgugcuccagccccgccugugcacccacgcccgguggcccgccccgaucuacggccugcucgucgaccccucccugcccagcaacccccaguggcagaacgggcgcgugcacguggacggcacccugcucggcaccaccccggucuccgggagcuggguguccugcuucgccgcggaggccgccuacgaguuccagagcggcaccggggaggucgccacguucacccugaucgagcaggacggcuccgccuacgugcccggggaccgggcggcgccccugggcuacccggacuucagcggccagcucgagaucgaggugcagaccgagaccacgaagaccggggacaagcugaaggucaccaccuucgagaugauccugggccccacgaccaacguggaccaggcccccuaccaggggcgcguguacgccagccucaccgccgucgccucccuggaccugguggacggccgggugcgcgccgucccccggagcaucuacggguuccaggacgugaucccggaguacaacgacggccuccuggugccccuggccccgcccaucggccccuuccuccccggggagguccugcugcgcuuccggaccuacaugcgccagcucgacacggccgacgcggccgccgaggccaucgacugcgcccugccccaggaguucaucuccugguucgcgagcaacgccuucaccgugcaguccgacgcccugcuccugcgguaccgcaacacccugaccggccagcuccuguucgagugcaagcuguacagcgagggguacaucgcccuguccuacagcggcuccgggccccucacguucccgaccgacggcuucuucgagguggucagcugggugccccgccuguuccagcuggccuccgugggcagccucaccaccgggcggacgcugaaguga

SEQ ID NO: 11396 - RNA, 1623 nt, Artificial Sequence
  derived and/or modified sequence opt1 from VP1__Norovirus_and/or_Norovirus-like__AB281085
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaucgcguccgggcacaacgagcccgccaaccggggccacgacgccguggugcccacguacaccgcccaguacacccccaagcugggccagauccagaucgggaccuggcagacggacgaccugaccgucaaccagccggugaaguucacccccgugggccucaacgacaccgaccacuucaaccagugggucgugccccgcuacgccggggcgcugaaccugaacacgaaccucgcccccagcguggccccggucuuccccggcgagcggcugcuguucuuccgcagcuacaucccccucaagggcggguacggcaaccccgccaucgacugccugcugccgcaggagugggugcagcacuucuaccaggaguccgcgcccagcauguccgagguggcccucguccgguacaucaaccccgacaccgggcgcgcccuguucgaggccaagcugcaccgggccggcuucaugaccgugagcuccaacaccagcgcgcccguggucgugccggccaacggguacuuccgcuucgacuccugggugaaccaguucuacagccucgcccccaugggcacggggaacggccggcgccgcuga

SEQ ID NO: 11397 - RNA, 1623 nt, Artificial Sequence
  derived and/or modified sequence opt1 from VP1__Norovirus_and/or_Norovirus-like__AB662868
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgagcaccuguacaacgucaccaucaucaaccugaacgggucccccuucgacccgagcgaggacauccccgcgccccucggcgugccggacuuccaggggcggguguucggcgucaucucccagcgcgacaagcacaacacccccgggcacaacgagcccgccaaccgggcccacgacgccguggugcccacguacaccgcccaguacaccccgaagcugggccagauccagaucggcaccuggcagacggacgaccugaccaacaaccagcccgucaaguucacccccguggggcucaacgacaccgagcacuucgaccaguggguggucccccgcuacgccggcgcccugaaccugaacacgaaccucgcgccgagcguggcccccguguuccccggggagcggcugcuguucuuccgcagcuacaucccccucaagggcggguacggcaccccggccaucgacugccugcugccccaggaguggguccagcacuucuaccaggaggccgcgcccuccaugagcgagguggcccucgugcgguacaucaaccccgacaccggccgcgcccuguucgaggccaagcugcaccgggccggguucaugaccgucuccagcaacacguccgcgccgguggugguccccgccaacggcuacuuccgcuucgacagcugggugaaccaguucuacucccucgcccccauggggaccggcaacgggcggcgccgcuga

SEQ ID NO: 11398 - RNA, 1623 nt, Artificial Sequence
  derived and/or modified sequence opt1 from VP1__Norovirus_and/or_Norovirus-like__AB662861
augaagauggccagcaacgacgccgugcccuccaccgacggcgcggccgggcuggucccggagagcaacaacgaggugauggcccucgagcccguggccggcgccgcgcuggccgcccccgucaccgggcagacgaacaucaucgaccccuggauccgcgccaacuucgugcaggcgccgaacggcgaguucaccgugagcccccggaacucccccggggagguccugcucaaccuggagcugggccccgagcucaacccguaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccccucccggacguccgcaacaacuucuuccacuacaaccagaaggacgaccccaagaugcggaucguggccaugcuguacacgccccugcgcuccaacggguccggcgacgacguguucaccgucagcugccgggugcucacccgccccuccccggacuucgacuucaccuaccuggugccgcccaccgucgagagcaagaccaagcccuucacccugcccauccucacgcugggcgagcuguccaacagccgguuccccguguccaucgaccagauguacaccagccccaacgaggugaucuccguccagugccagaacgggcgcugcacccucgacggcgagcugcaggggaccacgcagcugcaggucagcggcaucugcgcguucaagggcgaggugaccgcccaccuccacgacaacgagcaccuguacaacgugaccaucaccaaccugaacgggucccccuucgacccgagcgaggacauccccgcgccccucggcgugccggacuuccaggggcgggucuucggcgugaucucccagcgcgacaagcacaacacgcccgggcacaacgagcccgccaaccgggcccacgacgccgugguccccaccuacaccgcccaguacaccccgaagcugggccaggugcagaucggcacguggcagaccgacgaccugaccgacaaccagcccgugaaguucacccccgucgggcucaacgacacggagcacuucaaccaguggguggugccccgcuacgccggcgcccugaaccugaacaccaaccucgccccgagcgucgcgcccguguuccccggggagcggcugcuguucuuccgcagcuacaucccccucaagggcggguacggcaccccggccaucgacugccugcugccccaggagugggugcagcacuucuaccaggaggccgcccccuccaugagcgaggucgcgcucgugcgguacaucaaccccgacaccggccgcgcccuguucgaggccaagcugcaccgggccggguucaugacgguguccagcaacaccuccgccccggucguggugcccgcgaacggcuacuuccgcuucgacagcugggucaaccaguucuacucccucgcccccauggggaccggcaacgggcggcgccgcuga

SEQ ID NO: 11399 - RNA, 1623 nt, Artificial Sequence
  derived and/or modified sequence opt1 from VP1__Norovirus_and/or_Norovirus-like__LC145791
augaagauggccagcaacgacguggcccccuccaccgacggcgcggccgggcuggucccggagagcaacaacgaggugauggcccucgagcccguggccggcgccgcgcuggccgcccccgucaccgggcagacgaacaucaucgaccccuggauccgcgccaacuucgugcaggcgccgaacggcgaguucaccgugagcccccggaacucccccggggagguccugcucaaccuggagcugggccccgagcucaacccguaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccccucccggacguccgcaacaacuucuuccacuacaaccagaaggacgaccccaagaugcggaucguggccaugcuguacacgccccugcgcuccaacggguccggcgacgacguguucaccgucagcugccgggugcucacccgccccuccccggacuucgacuucaccuaccuggugccgcccaccgucgagagcaagaccaagcccuucacccugcccauccucacgcugggcgagcuguccaacagccgguuccccguguccaucgaccagauguacaccagccccaacgaggugaucuccguccagugccagaacgggcgcugcacccucgacggcgagcugcaggggaccacgcagcugcaggucagcggcaucugcgcguucaagggcgaggugaccgcccaccuccacgacaacgaccaccuguacaacgugaccaucaccaaccugaacgggucccccuucgacccgagcgaggacauccccgcgccccucggcgugccggacuuccaggggcgggucuucggcgugaucucccagcgcgacaagcacaacacgcccgggcacaacgagcccgccaaccgggcccacgacgccgugguccccaccuacaccgcccaguacaccccgaagcugggccagauccagaucggcacguggcagaccgacgaccugaccgugaaccagcccgugaaguucacccccgucgggcucaacgacacggaccacuucaaccaguggguggugccccgcuacgccggcgcccugaaccugaacaccaaccucgccccgagcgucgcgcccguguuccccggggagcggcugcuguucuuccgcagcuacaucccccucaagggcggguacggcaccccggccaucgacugccugcugccccaggagugggugcagcacuucuaccaggaggccgcccccuccaugagcgaggucgcgcucgugcgguacaucaaccccgacaccggccgcgcccuguucgaggccaagcugcaccgggccggguucaugacgguguccagcaacaccuccgccccggucguggugcccgcgaacggcuacuuccgcuucgacagcugggucaaccaguucuacucccucgcccccauggggaccggcaacgggcggcgccgcuga

SEQ ID NO: 11400 - RNA, 1623 nt, Artificial Sequence
  derived and/or modified sequence opt1 from VP1__Norovirus_and/or_Norovirus-like__LC145790
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccccggccaucgacugccugcugccccaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgccgguggucgugcccgccaacggcuacuuccgcuucgacagcugggugaaccaguucuacucccucgcccccauggggaccggcaacgggcggcgccgcuga

SEQ ID NO: 11401 - RNA, 1623 nt, Artificial Sequence
  derived and/or modified sequence opt1 from VP1__Norovirus_and/or_Norovirus-like__LC145793
augaagauggccagcaacgacgccgcgcccuccaccgacggcgccgccgggcuggugccggagagcaacaacgaggucauggcccucgagcccguggccggcguggcgcuggccgcccccgucaccgggcagacgaacaucaucgaccccuggauccgcgccaacuucgugcaggcgccgaacggcgaguucaccgugagcccccggaacucccccggggagguccugcucaaccuggagcugggccccgagcucaacccguaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccccucccggacguccgcaacaacuucuuccacuacaaccagaaggacgaccccaagaugcggaucguggccaugcuguacacgccccugcgcuccaacggguccggcgacgacguguucaccgucagcugccgggugcucacccgccccuccccggacuucgacuucaccuaccuggugccgcccaccgucgagagcaagaccaagcccuucacccugcccauccucacgcugggcgagcuguccaacagccgguuccccguguccaucgaccagauguacaccagccccaacgaggugaucuccguccagugccagaacgggcgcugcacccucgacggcgagcugcaggggaccacgcagcugcaggucagcggcaucugcgcguucgagggcgaggugaccgcccaccuccacgacaacgaccaccuguacaacgugaccaucaccaaccugaacgggucccccuucgacccgagcgaggacauccccgcgccccucggcgugccggacuuccaggggcgggucuucggcgugaucucccagcgcgacaagcacaacacgcccgggcacaacgagcccgccaaccgggcccacgacgccgugguccccaccuacaccgcccaguacaccccgaagcugggccagauccagaucggcacguggcagaccgacgaccugaccgugaaccagcccgugaaguucacccccgucgggcucaacgacacggaccacuucaaccaguggguggugccccgcuacgccggcgcccugaaccugaacaccaaccucgccccgagcgucgcgcccguguuccccggggagcggcugcuguucuuccgcagcuacaucccccucaagggcggguacggcaccccggccaucgacugccugcugccccaggagugggugcagcacuucuaccaggaggccgcccccuccaugagcgaggucgcgcucgugcgguacaucaaccccgacaccggccgcgcccuguucgaggccaagcugcaccgggccggguucaugacgguguccagcaacaccuccgccccggucguggugcccgcgaacggcuacuuccgcuucgacagcugggucaaccaguucuacucccucgcccccauggggaccggcaacgggcggcgccgcuga

SEQ ID NO: 11402 - RNA, 1623 nt, Artificial Sequence
  derived and/or modified sequence opt1 from VP1__Norovirus_and/or_Norovirus-like__LC145792
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccaguggguccugccccgcuacgccggcgcccugaaccucaacaccaaccuggcgccgagcguggcccccguguuccccggggagcggcuccuguucuuccgcagcuacaucccccugaagggcggguacggcaccccggccaucgacugccugcucccccaggaguggguccagcacuucuaccaggaggccgcgcccuccaugagcgagguggcccuggugcgguacaucaaccccgacaccggccgcgcccuguucgaggccaagcuccaccgggccggguucaugacggucuccagcaacaccuccgcgccgguggugguccccgccaacggcuacuuccgcuucgacagcugggugaaccaguucuacucccuggcccccauggggaccggcaacgggcggcgccgcuga

SEQ ID NO: 11403 - RNA, 1623 nt, Artificial Sequence
  derived and/or modified sequence opt1 from VP1__Norovirus_and/or_Norovirus-like__LC145797
augaagauggccagcaacgacgccgcgcccuccaccgacggcgccgccgggcuggugccggagagcaacaacgaggucauggcccucgagcccguggccggcguggcgcuggccgcccccgucaccgggcagacgaacaucaucgaccccuggauccgcgccaacuucgugccggcgcccaacggcgaguucaccgugagcccccggaacucccccggggagguccugcucaaccuggagcugggcccggagcucaaccccuaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccgcuccccgacguccgcaacaacuucuuccacuacaaccagaaggacgaccccaagaugcggaucguggccaugcuguacacgccccugcgcuccaacggguccggcgacgacguguucaccgucagcugccgggugcucacccgcccgucccccgacuucgacuucaccuaccuggugccgcccaccgucgagagcaagaccaagcuguucacccuccccauccugacgcugggcgagcucuccaacagccgguuccccguguccaucgaccagauguacaccagccccaacgaggugaucuccguccagugccagaacgggcgcugcacccuggacggcgagcugcaggggaccacgcagcuccaggugagcggcaucugcgcguucaagggcgaggucaccgcccaccuccacgacaacgaccaccuguacaacgugaccaucaccaaccucaacgggucccccuucgacccgagcgaggacauccccgcgccccugggcgugccggacuuccaggggcgggucuucggcgugaucucccagcgcgacaagcacaacaucagcgggcacaacgagcccgccaaccgggcccacgacgccgugguccccacguacaccgcccaguacacccccaagcugggccagauccagaucggcaccuggcagacggacgaccucaccgugaaccagccggugaaguucacccccgucgggcugaacgacaccgaccacuucaaccaguggguggugccccgcuacgccggcgcccugaaccucaacacgaaccuggcccccagcgucgcgccgguguuccccggggagcggcugcuguucuuccgcuccuacaucccccugaagggcggguacggcacccccgccaucgacugccugcucccgcaggagugggugcagcacuucuaccaggaggccgcccccagcauguccgaggucgcgcuggugcgguacaucaaccccgacaccggccgcgcccuguucgaggccaagcuccaccgggccggguucaugaccgugagcuccaacacgagcgcccccgucguggugccggcgaacggcuacuuccgcuucgacuccugggucaaccaguucuacagccuggcccccauggggaccggcaacgggcggcgccgcuga

SEQ ID NO: 11404 - RNA, 1623 nt, Artificial Sequence
  derived and/or modified sequence opt1 from VP1__Norovirus_and/or_Norovirus-like__LC145808
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacgcccccgggcacaacgagcccgccaaccgggcccacgacgccguggugcccacguacaccgcccaguacaccccgaagcugggccagauccagaucggcaccuggcagacggacgaccugaccgucaaccagcccgugaaguucacccccguggggcucaacgacaccgaccacuucaaccagugggucgugccccgcuacgccggcgcgcugaaccugaacacgaaccucgccccgagcguggcccccgucuuccccggggagcggcugcuguucuuccgcagcuacaucccccucaagggcggguacggcaccccggccaucgacugccugcugccccaggagugggugcagcacuucuaccaggaggcggcccccuccaugagcgagguggcccucguccgguacaucaaccccgacaccggccgcgcccuguucgaggccaagcugcaccgggcgggguucaugaccguguccagcaacacguccgccccgguggucgugcccgccaacggcuacuuccgcuucgacagcugggugaaccaguucuacucccucgcccccauggggaccggcaacgggcggcgccgcuga

SEQ ID NO: 11405 - RNA, 1623 nt, Artificial Sequence
  derived and/or modified sequence opt1 from VP1__Norovirus_and/or_Norovirus-like__LC145801
augaagauggccagcaacgacgccgcgcccuccaccgacggcgccgccgggcuggugccggagagcaccaacgaggucauggcccucgagcccguggccggcgcggcccuggccgcccccgugacggggcagaccaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucacgauguucccccacgugaucaucgacguccggacccucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacgcugcccauccucacccugggcgagcuguccaacagccgguuccccgucuccaucgaccagauguacaccagccccaacgaggugaucuccgugcagugccagaacgggcgcugcacccucgacggcgagcugcaggggacgacccagcugcaggucagcggcaucugcgccuucaagggcgaggugaccgcccaccuccacgacaacgaccaccuguacaacgucaccaucacgaaccugaacgggucccccuucgacccgagcgaggacauccccgcgccccucggcgccccggacuuccaggggcggguguucggcgugaucucccagcgcgacaagcacaacacccccgggcacaacgagcccgccaaccgggcccacgacgccgucgugcccaccuacaccgcccaguacacgccgaagcugggccagauccagaucggcaccuggcagaccgacgaccugaccgugaaccagcccgucaaguucacgcccguggggcucaacgacaccgaccacuucaaccaguggguggucccccgcuacgccggcgcgcugaaccugaacaccaaccucgccccgagcguggcccccguguuccccggggagcggcugcuguucuuccgcagcuacaucccccucaagggcggguacggcaccccggccaucgacugccugcugccccaggaguggguccagcacuucuaccaggaggcggcccccuccaugagcgagguggcccucgugcgguacaucaaccccgacacgggccgcgcccuguucgaggccaagcugcaccgggcgggguucaugaccgucuccagcaacaccuccgccccgguggugguccccgccaacggcuacuuccgcuucgacagcugggugaaccaguucuacucccucgcccccauggggaccggcaacgggcggcgccgcuga

SEQ ID NO: 11406 - RNA, 1623 nt, Artificial Sequence
  derived and/or modified sequence opt1 from VP1__Norovirus_and/or_Norovirus-like__AB662884
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaacuucacccccguggggcucagcgacacggaccacuucaaccagugggucgugccccgcuacgccggcgcccugaaccugaacaccaaccucgcgccgagcguggcccccgucuuccccggggagcggcugcuguucuuccgcuccuacaucccccucaagggcggguacggcaccccggccaucgacugccugcugccccaggagugggugcagcacuucuaccaggaggccgcgcccagcauguccgagguggcccucguccgguacaucaaccccgacaccggccgcgcccuguucgaggccaagcugcaccgggccggguucaugacggugagcuccaacaccagcgcgccgguggucgugcccgccaacggcuacuuccgcuucgacuccugggugaaccaguucuacagccucgcccccauggggaccggcaacgggcggcgccgcuga

SEQ ID NO: 11407 - RNA, 1623 nt, Artificial Sequence
  derived and/or modified sequence opt1 from VP1__Norovirus_and/or_Norovirus-like__LC145802
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggccacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgaguucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggccagcggcaucugcgccuucaagggcgaggucaccgcccaccuccacgacaacgaccaccuguacaacgugaccaucaccaaccugaacgggucccccuucgacccgagcgaggacauccccgcgccccucggcgucccggacuuccaggggcggguguucggcgugaucucccagcgcgacaagcacaacgcccccgggcacaacgagcccgccaaccgggcccacgacgccgucgugcccacguacaccgcccaguacaccccgaagcugggccagauccagaucggcaccuggcagacggacgaccugaccgugaaccagcccgucaaguucacccccguggggcucaacgacaccgaccacuucgaccaguggguggucccccgcuacgcgggcgcccugaaccugaacacgaaccucgccccgagcguggcccccguguuccccggggagcggcugcuguucuuccgcagcuacaucccccucaagggcggguacggcaccccggcgaucgacugccugcugccccaggaguggguccagcacuucuaccaggaggccgcccccuccaugagcgagguggcccucgugcgguacaucaaccccgacaccggccgcgcccuguucgaggcgaagcugcaccgggccggguucaugaccgucuccagcaacacguccgccccgguggugguccccgccaacggcuacuuccgcuucgacagcugggugaaccaguucuacucccucgcccccauggggaccggcaacgggcggcgccgcuga

SEQ ID NO: 11408 - RNA, 1623 nt, Artificial Sequence
  derived and/or modified sequence opt1 from VP1__Norovirus_and/or_Norovirus-like__AB662897
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccuccgccaucgacugccugcugccgcaggagugggugcagcacuucuaccaggaggccgcgcccagcauguccgagguggcccucguccgguacaucaaccccgacaccggccgcgcccuguucgaggccaagcugcaccgggccggguucaugacggugagcuccaacaccagcgcgcccguggucgugccggccaacggcuacuuccgcuucgacuccugggugaaccaguucuacagccucgcccccauggggaccggcaacgggcggcgccgcuga

SEQ ID NO: 11409 - RNA, 1623 nt, Artificial Sequence
  derived and/or modified sequence opt1 from VP1__Norovirus_and/or_Norovirus-like__AB662899
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaacuucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccccggccaucgacugccugcugccccaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgccgguggucgugcccgccaacggcuacuuccgcuucgacagcugggugaaccaguucuacucccucgcccccauggggaccggcaacgggcggcgccgcuga

SEQ ID NO: 11410 - RNA, 1623 nt, Artificial Sequence
  derived and/or modified sequence opt1 from VP1__Norovirus_and/or_Norovirus-like__AB662894
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgccaacuucacccccguggggcucagcgacacggaccacuucaaccaguggguggucccccgcuacgccggcgcgcugaaccugaacaccaaccucgccccgagcguggcccccguguuccccggggagcggcugcuguucuuccgcuccuacaucccccucaagggcggguacggcaccccggccaucgacugccugcugccccaggaguggguccagcacuucuaccaggaggcggcccccagcauguccgagguggcccucgugcgguacaucaaccccgacaccggccgcgcccuguucgaggccaagcugcaccgggcgggguucaugacggucagcuccaacaccagcgccccgguggugguccccgccaacggcuacuuccgcuucgacuccugggugaaccaguucuacagccucgcccccauggggaccggcaacgggcggcgccgcuga

SEQ ID NO: 11411 - RNA, 1623 nt, Artificial Sequence
  derived and/or modified sequence opt1 from VP1__Norovirus_and/or_Norovirus-like__LC145803
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacggguccagcuucgaccccuccgaggacaucccggcgccccucggcauccccgacuuccaggggcggguguucggcgugaucagccagcgcgacaagcacaacacgccggggcacaacgagcccgccaaccgggcccacgacgccgucgugcccaccuacaccgcccaguacacccccaagcugggccagauccagaucggcacguggcagaccgacgaccugaccgugaaccagccggucaaguucacccccguggggcucaacgacacggaccacuucaaccaguggguggucccccgcuacgccggcgcccugaaccugaacaccaaccucgcgcccagcguggccccgguguuccccggggagcggcugcuguucuuccgcuccuacaucccccucaagggcggguacggcacccccgccaucgacugccugcugccgcaggaguggguccagcacuucuaccaggaggccgcgcccagcauguccgagguggcccucgugcgguacaucaaccccgacaccggccgcgcccuguucgaggccaagcugcaccgggccggguucaugacggucagcuccaacaccagcgcgcccgugguggucccggccaacggcuacuuccgcuucgacuccugggugaaccaguucuacagccucgcccccauggggaccggcaacgggcggcgccgcuga

SEQ ID NO: 11412 - RNA, 1623 nt, Artificial Sequence
  derived and/or modified sequence opt1 from VP1__Norovirus_and/or_Norovirus-like__AB662889
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaaguccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgaccccuccgaggacaucccggcgccccucggcgugcccgacuuccaggggcggguguucggcgucaucagccagcgcgacaagcacaacacgccggggcacaacgagcccgccaaccgggcccacgacgccguggugcccaccuacaccgcccaguacacccccaagcugggccagauccagaucggcacguggcagaccgacgaccugaccgucaaccagccggugaacuucacccccguggggcucagcgacacggaccacuucaaccagugggucgugccccgcuacgccggcgcccugaaccugaacaccaaccucgcgcccuccguggccccggucuuccccggggagcggcugcuguucuuccgcagcuacaucccccucaagggcggguacggcacccccgccaucgacugccugcugccgcaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgcccguggucgugccggccaacggcuacuuccgcuucgacagcugggugaaccaguucuacucccucgcccccauggggaccggcaacgggcggcgccgcuga

SEQ ID NO: 11413 - RNA, 1623 nt, Artificial Sequence
  derived and/or modified sequence opt1 from VP1__Norovirus_and/or_Norovirus-like__AB662876
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaacuucacccccgccgggcucagcgacacggaccacuucaaccaguggguggucccccgcuacgccggcgcgcugaaccugaacaccaaccucgccccgagcguggcccccguguuccccggggagcggcugcuguucuuccgcuccuacaucccccucaagggcggguacggcaccccggccaucgacugccugcugccccaggaguggguccagcacuucuaccaggaggcggcccccagcauguccgagguggcccucgugcgguacaucaaccccgacaccggccgcgcccuguucgaggccaagcugcaccgggcgggguucaugacggucagcuccaacaccagcgccccgguggugguccccgccaacggcuacuuccgcuucgacuccugggugaaccaguucuacagccucgcccccauggggaccggcaacgggcggcgccgcuga

SEQ ID NO: 11414 - RNA, 1620 nt, Artificial Sequence
  derived and/or modified sequence opt1 from VP1__Norovirus_and/or_Norovirus-like__KU555841
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucggguccgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggaccggcaacggccgccggcgcgcgcaguga

SEQ ID NO: 11415 - RNA, 1620 nt, Artificial Sequence
  derived and/or modified sequence opt1 from VP1__Norovirus_and/or_Norovirus-like__GQ856468
augaagauggccagcaacgacgccgcgcccuccaacgacggcgccaccgggcuggugccggagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugagccgcauguacaacggcuacgccgggggcguggaggugcagguccugcucgccgggaacgccuucaccgccggcaagauccuguucgccgcggugccgcccaacuuccccguggacaugcugucccccgcccagaucacgaugcucccccaccugaucgucgacgugcggacccuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacgcggcccacccccgacuucgaguucaccuaccuggugcccccguccgucgagagcaagaccaagcccuucacgcuccccauccugaccaucggcgagcugaccaacucccgcuuccccgccccgaucgaccagcucuacaccagccccaacgcggacaucguggugcagccccagaacgggcggugcacgcuggacggcgagcugcaggggaccacccagcuccugaccacggccaucugcuccuaccgcggcaugaccagcaacccgaccuccgacuacugggacgaccaccuccugcaccugguccaccccaacggcgccaccuacgaccccacggaggacgugcccgccccguucgggacccaggacuuccggggcauccuguacgggaugcucacccagaacccccgcaccagcggcgacgaggccgcgaacucccacgggaucuacaucagcuccacgagcgagaaguucacccccaagcugggcaccaucggccugcaccaggugcaggggcggcacagccagcaccagcaguccaaguucacccccgucggcaucgccgugaacgggaacacgccguuccgccagugggagcuccccaacuacagcggcgcccugacccugaacaccaaccucgcccccgccgucgggcccaacuucccgggcgagcagauccuguucuuccgguccaacgugcccagcgugcagggcgggcagcccaucgagaucgacugccugaucccccaggagugggucucccacuucuaccaggagagcgcgccgucccagagcgacguggcccucgugcgcuacgucaaccccgacaccggccggacgaucuucgaggccaagcugcaccgccagggguucaucaccaucgccgcgaccggcuccaaccccgugguggugcccccgaacggguacuuccgguucgacagcugggucaaccaguucuacgcccuggcccccaugggcaccggcaacgggcgccgccgggugcaguga

SEQ ID NO: 11416 - RNA, 1620 nt, Artificial Sequence
  derived and/or modified sequence opt1 from VP1__Norovirus_and/or_Norovirus-like__AB684681
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccgccaaccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccgcgcccaucgacagccuguucaccgcccagaacaacguccuccaggugcagugccagaacgggcggugcacccuggacggcgagcugcaggggacgacccagcuccugccgaccggcaucugcgccuuccgcggccgggugaccgccgagacggacaaccccgacaaguggcacaugcagcugcagaaccucaacgggaccaccuacgaccccaccgacgacgucccggcgccccugggcacgcccgacuuccgcgggcuccuguucggcguggccucccagcggaacguggggaacgacgcccccggcagcacccgcgcccacgaggucgugaucuccaccaccagcccgcaguucguccccaagcugggcuccaucaacuuccggagcacgagcgaggacuuccgcaccgggcagcccacccgguucacccccgugggcaucaacgacgaggacaaccacccguucaaccagugggagcugcccgacuacuccgggcgccucacgcugaacaugaaccuggccccgcccguggcccccaacuuccccggcgagcagcuccuguucuuccggagcaacguccccugcuccgggggcuacaaccagggcaucaucgacugccugaucccccaggaguggauccagcacuucuaccaggagagcgcgccgucccagagcgagguggcccucauccgcuacgugaaccccgacaccgggcgcacccuguucgaggccaagcugcaccggaccggcuacaucacggucgcccacuccggggacuacccccucguggugcccgcgaacggcuacuuccgcuucgacagcugggucaaccaguucuacucccuggccccgauggggaccggcaacggccggcgccgggcccaguga

SEQ ID NO: 11417 - RNA, 1620 nt, Artificial Sequence
  derived and/or modified sequence opt1 from VP1__Norovirus_and/or_Norovirus-like__AB809988
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggccgccgcuga

SEQ ID NO: 11418 - RNA, 1620 nt, Artificial Sequence
  derived and/or modified sequence opt1 from VP1__Norovirus_and/or_Norovirus-like__AB810011
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugggugaaccaguucuacucccucgcccccaugggcaccgggaacggccgccgguga

SEQ ID NO: 11419 - RNA, 1620 nt, Artificial Sequence
  derived and/or modified sequence opt1 from VP1__Norovirus_and/or_Norovirus-like__AB809994
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcagcggcaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggcuucaucacggugagccacaccggggccuacccccugguggucccgcccaacggccacuuccgguucgacuccugggugaaccaguucuacagccucgcccccauggggaccggcaacgggcgccgcuga

SEQ ID NO: 11420 - RNA, 1620 nt, Artificial Sequence
  derived and/or modified sequence opt1 from VP1__Norovirus_and/or_Norovirus-like__KX767083
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccauccccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccacaacuacaccaugaaccuggccucccagaacuggaacagcuacgacccgaccgaggagauccccgcgccccuggggacgcccgacuucgugggcaagauccagggggugcucacccagaccacccgcgccgacggcagcacgcgggggcacaaggccaccgucuacaccggcuccgccgacuucgccccgaagcugggccgcgugcaguucgggaccgacacgagcaacgacuucgaggccaaccagaacaccaaguucacccccgugggcgucauccaggacggggacaccacgcaccggaacgagccccagcagugggugcugcccuccuacagcggccgcaacacccacaacgugcaccucgcgccggccgucgcccccaccuuccccggggagcagcugcuguucuuccgguccaccaugcccggcugcagcggcuacccgaacauggaccucgacugccugcugccccaggagugggugcagcacuucuaccaggaggccgcgcccgcccaguccgacguggcccuccugcgcuucgucaaccccgacacggggcgggugcuguucgagugcaagcuccacaagccgggcuacgugaccgucgcccacaccgggcagcacgaccuggugaucccgcccaacggcuacuuccgcuucgacagcugggugaaccaguucuacacccuggcccccauggggaacggcaccggccggcgccgcgucuga

SEQ ID NO: 11421 - RNA, 1620 nt, Artificial Sequence
  derived and/or modified sequence opt1 from VP1__Norovirus_and/or_Norovirus-like__LN854565
augaagauggccagcaacgacgccaaccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgacgacgucuucaccgugagcugccgcgugcugacccggcccuccccggacuucgacuucaucuuccucgucccgcccaccguggagagccgcaccaagcccuucacgauccccauccugaccguggaggagaugaccaacucccgguuccccaucccccuggagaagcucuacaccggccccagcuccgccuucgucgugcagccgcagaacgggcgcugcacgaccgacggcgugcugcuggggaccacccagcucagccccgucaacaucugcacguuccggggcgacgugaccaacauccagggcucccacaccuacaccaugaaccuggccagccugaacuggaacaacuacgaccccacggaggagaccccggcgccccucgggacccccgacuucgucggcaagauccagggggugcugacccagacgaccaagggccagggguccacccgcggccacaaggccaccguguacacgggcagcgccagcuucacccccaagcugggguccguccaguuccggaccgacacccagaacgacuucgugacgcaccagaacaccaaguucaccccggugggcgucauccaggacggggacaccacgcaccgcaacgagccccagcagugggugcuccccaacuacagcggcgugaacacccacaacguccaccuggcccccgccguggccccgaccauccccggggagcagcuccuguucuuccgguccagcaugcccggcugcuccggcuaccccaacauggaccuggacugccuggugccgcaggaguggguccagcacuucuaccaggaggcggcccccgcccucagcgacguggcccugcugcgcuucgugaaccccgacaccgggcggguccucuucgagugcaagcugcacaaguccggcuacgugaccguggcgcacacggggcaccacgaccuggucaucccgcccaacggcuacuuccgcuucgacagcugggugaaccaguucuacacccucgcccccauggggaacggcaccggccggcgccggguguga

SEQ ID NO: 11422 - RNA, 1620 nt, Artificial Sequence
  derived and/or modified sequence opt1 from VP1__Norovirus_and/or_Norovirus-like__KX354071
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccagaacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcguguga

SEQ ID NO: 11423 - RNA, 1620 nt, Artificial Sequence
  derived and/or modified sequence opt1 from VP1__Norovirus_and/or_Norovirus-like__AB933688
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcgcuucuccacggacaccgagaacgacuucgagauccaccagaacaccaaguucacccccgugggcgucauccaggacgggagcacgacccaccggaacgagccccagcagugggugcuccccuccuacagcggccgcgacgcccacaacgugcaccuggccccggcggucgcccccaccuuccccggggagcagcuccucuucuuccgguccaccaugcccggcugcagcggcuacccgaacauggaccuggacugccugcucccccaggagugggugcagcacuucuaccaggaggccgcccccgcgcaguccgacguggcccugcugcgcuucgucaaccccgacacggggcggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcaccggccggcgccgcgucuga

SEQ ID NO: 11424 - RNA, 1620 nt, Artificial Sequence
  derived and/or modified sequence opt1 from VP1__Norovirus_and/or_Norovirus-like__GQ845337
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgaggcccaccagaacaccaaguucacccccgucggcgugauccaggacgggggcacgacccaccgcaacgagccccagcagugggugcuccccagcuacuccgggcggaacgucccgaacgugcaccuggcccccgcgguggcccccaccuuccccggcgagcagcuccucuucuuccgcagcaccaugccgggcugcuccggguaccccaacauggaccuggacugccugcucccccaggaguggguccagcacuucuaccaggaggccgcccccgcgcagagcgacguggcccugcugcgguucgugaacccggacacgggccgcguccucuucgagugcaagcugcacaaguccggguacgugaccguggcccacaccggccagcacgaccuggucauccccagcaacggguacuuccgguucgacuccugggugaaccaguucuacacccucgcccccaugggcaacggcaccgggcgccggcgcguguga

SEQ ID NO: 11425 - RNA, 1620 nt, Artificial Sequence
  derived and/or modified sequence opt1 from VP1__Norovirus_and/or_Norovirus-like__JX155747
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcguguga

SEQ ID NO: 11426 - RNA, 1620 nt, Artificial Sequence
  derived and/or modified sequence opt1 from VP1__Norovirus_and/or_Norovirus-like__JX155737
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcguguga

SEQ ID NO: 11427 - RNA, 1620 nt, Artificial Sequence
  derived and/or modified sequence opt1 from VP1__Norovirus_and/or_Norovirus-like__KX354055
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcgccgacggcagcacgcgggggcacaaggccaccguguacaccggcagcgccgacuucgccccgaagcugggccgcgugcaguucgagaccgacacgaaccacgacuucgaggccaaccagaacaccaaguucacccccgucggggugauccaggacggcgggaccacgcaccggaacgagccccagcagugggugcugcccuccuacagcggccgcaacacccacaacguccaccucgcgccggccguggcccccaccuuccccggggagcagcugcuguucuuccgguccaccaugcccggcugcagcggcuacccgaacauggaccucgacugccugcugccccaggagugggugcagcacuucuaccaggaggccgcgcccgcccaguccgacgucgcccuccugcgcuucgugaaccccgacacggggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcaccggccggcgccgcguguga

SEQ ID NO: 11428 - RNA, 1620 nt, Artificial Sequence
  derived and/or modified sequence opt1 from VP1__Norovirus_and/or_Norovirus-like__KX353957
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguucaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcguguga

SEQ ID NO: 11429 - RNA, 1620 nt, Artificial Sequence
  derived and/or modified sequence opt1 from VP1__Norovirus_and/or_Norovirus-like__KF509947
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccgggccgacggcagcacgcgcgggcacaaggccaucgucuacaccggcagcgccgacuucgccccgaagcugggccgggugcaguucgagaccgacaccgaccacgacuucgaggccaaccagaacacgaaguucacccccgugggggucacccaggacggcuccaccacgcaccgcaacgagccccagcagugggugcugcccagcuacuccgggcggaacacccacaacgugcaccucgcgccggccgucgcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgggucuga

SEQ ID NO: 11430 - RNA, 1620 nt, Artificial Sequence
  derived and/or modified sequence opt1 from VP1__Norovirus_and/or_Norovirus-like__AB504326
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaucaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacacccgcuucacccccgucggcgugauccaggacgggggcacgacccaccggaacgagccccagcagugggugcuccccagcuacuccgggcgcaacgucccgaacgugcaccuggcccccgccguggcgcccaccuuccccggcgagcagcuccucuucuuccggagcaccaugccgggcugcuccggguaccccaacauggaccuggacugccugcucccccaggaguggguccagcacuucuaccaggaggccgcccccgcccagagcgacguggcgcugcugcgcuucgugaacccggacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgcguguga

SEQ ID NO: 11431 - RNA, 1620 nt, Artificial Sequence
  derived and/or modified sequence opt1 from VP1__Norovirus_and/or_Norovirus-like__KX354056
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccgggccgacggcagcacgcgcgggcacaaggccaccgucuacaccggcagcgccgacuucgccccgaagcugggccgggugcaguucgggaccgacacggaccacgacuucgaggccaaccagaacaccaaguucacccccgugggcgucauccaggacgggggcaccacgcaccgcaacgagccccagcagugggugcugcccuccuacagcgggcggaacacccacaacgugcaccucgcgccggccgucgcccccaccuuccccggcgagcagcugcuguucuuccgcuccaccaugcccggcugcagcggguacccgaacauggaccucgacugccugcugccccaggagugggugcaguacuucuaccaggaggccgcgcccgcccaguccgacguggcccuccugcgguucgucaaccccgacacgggccgcgugcuguucgagugcaagcuccacaagcugggguacgugaccgucgcccacaccggccagcacgaccuggugaucccgcccaacggguacuuccgguucgacagcugggugaaccaguucuacacccucgcccccaugggcaacggcaccgggcgccgccgggucuga

SEQ ID NO: 11432 - RNA, 1620 nt, Artificial Sequence
  derived and/or modified sequence opt1 from VP1__Norovirus_and/or_Norovirus-like__AB541255
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacacccgcuucacgcccgucggcgugauccaggacgggggcaccacccaccggaacgagccccagcagugggugcuccccagcuacuccgggcgcaacgucccgaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcguguga

SEQ ID NO: 11433 - RNA, 1620 nt, Artificial Sequence
  derived and/or modified sequence opt1 from VP1__Norovirus_and/or_Norovirus-like__KP784696
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcgagauccaggggguccucacccagaccacccggacggacggcagcacccgcgggcacaaggccaccguguacaccggcagcgccgacuucgccccgaagcugggccggauccaguucgagacggacaccgaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccagccaguccgacguggcgcuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggucuga

SEQ ID NO: 11434 - RNA, 1620 nt, Artificial Sequence
  derived and/or modified sequence opt1 from VP1__Norovirus_and/or_Norovirus-like__KX354042
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucuccagcgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccggguguga

SEQ ID NO: 11435 - RNA, 1620 nt, Artificial Sequence
  derived and/or modified sequence opt1 from VP1__Norovirus_and/or_Norovirus-like__KX354007
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggaggugcccgcgccccuggggacgcccgacuucgucggcaagauccaggggaugcucacccagaccacccggacggacggcagcacccgcgggcacaaggccaccguguacaccggcagcgccgacuucacgccgaagcugggccggauccaguucgagaccgacaccgaccacgacuucgaggccaaccagaacaccaaguucacgcccgugggggucauccaggacggcuccaccacccaccgcaacgagccccagcagugggugcugcccagcuacuccgggcggaacacccacaacgugcaccucgccccggccgucgcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacguggcgcuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacgcuggcccccaugggcaacgggaccggccgccgccgggucuga

SEQ ID NO: 11436 - RNA, 1620 nt, Artificial Sequence
  derived and/or modified sequence opt1 from VP1__Norovirus_and/or_Norovirus-like__KT780393
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagcgccucuucaccggcccguccagcgccuucgucgugcagccccagaacgggcggugcaccacggacggcgugcugcuggggaccacccagcucacccccgucaacaucugcacguuccgcggcgacgugacccacaucaccggcucccggaacuacaccaugaaccuggccagccagaacuggaacaacuacgacccgacggaggagauccccgcgccccuggggacccccgacuucgugggcaagauccaggggaugcucacccagaccacgcgcaccgacggcuccacccgggggcacaaggccaccgucuacacgggcagcgccgacuucgccccgaagcugggccgcgugcaguucgagaccgacaccgaccacgacuucgaggccaaccagaacaccaaguucacgcccgugggggucauccaggacggcagcaccacccaccggaacgagccccagcagugggugcugcccuccuacagcgggcgcaacacccacaacgugcaccucgccccggcggucgcccccacguuccccggcgagcagcugcuguucuuccgguccaccaugcccgggugcagcggcuacccgaacauggaccucgacugccugcugccccaggagugggugcagcacuucuaccaggaggccgcccccgcgcaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacgcuggcccccaugggcaacgggaccggccgccggcgcgucuga

SEQ ID NO: 11437 - RNA, 1620 nt, Artificial Sequence
  derived and/or modified sequence opt1 from VP1__Norovirus_and/or_Norovirus-like__KX354043
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacaccuacaacguccaccucgcccccgcgguggccccgaccuuccccggcgagcagcugcuguucuuccgcuccacgaugcccgggugcagcggcuaccccaacauggaccucgacugccugcugccgcaggagugggugcagcacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccggguguga

SEQ ID NO: 11438 - RNA, 1620 nt, Artificial Sequence
  derived and/or modified sequence opt1 from VP1__Norovirus_and/or_Norovirus-like__KX354008
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggaggugcccgcgccccuggggacgcccgacuucgucggcaagauccaggggaugcucacccagaccacccggacggacggcagcacccgcgggcacaaggccaccguguacaccggcagcgccgacuucacgccgaagcugggccggauccaguucgagaccgacaccgaccacgacuucgaggccaaccagaacaccaaguucacgcccgugggggucauccaggacggcuccaccacccaccgcaacgagccccagcagugggugcugcccagcuacuccgggcggaacacccacaacgugcaccucgccccggccgucgcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacguggcgcuccugcgguucgucaaccccgacaccggccgcgugcuguucgagugcaagcuccacaaguccggguacgugaccgucgccuacaccggccagcacgaccuggugaucccgcccaacggguacuuccgguucgacagcugggugaaccaguucuacacgcuggcccccaugggcaacgggaccggccgccgccgggucuga

SEQ ID NO: 11439 - RNA, 1620 nt, Artificial Sequence
  derived and/or modified sequence opt1 from VP1__Norovirus_and/or_Norovirus-like__KR904217
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgcguucgugguccagccccagaacgggcgcugcagcacggacggcgugcuccuggggaccacccagcucucccccgucaacaucugcaccuuccggggcgacgugacgcacaucgccggcagccacaacuacaccaugaaccuggccagccagaacugguccagcuacgacccgaccgaggagauccccgcgccccuggggacccccgacuucgugggcaagauccaggggguccucacgcagaccacccgcuccgacggcagcacccgggggcacaaggccacgguguacaccggcuccgccgacuucagcccgaagcugggccgcgugcaguucgccaccgacaccgacaacgacuucgucuccaaccagaacacgaaguucacccccgugggggugauccaggacggcgacaccgcccaccggaacgagccccagcaguggguccugcccagcuacuccgggcgcaacauccacaacgugcaccucgccccggccguggcgcccaccuuccccggcgagcagcugcuguucuuccggagcacgauccccgggugcuccggcuacccgaacauggaccucgacugccugcugccccaggaguggguccaguacuucuaccaggaggccgcccccgcccagagcgacguggcgcuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccacuucuacacgcuggcccccaugggcaacgggaccggccggcgccgcguguga

SEQ ID NO: 11440 - RNA, 1620 nt, Artificial Sequence
  derived and/or modified sequence opt1 from VP1__Norovirus_and/or_Norovirus-like__KJ685412
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgccacggacaccgaccacgacuucgaggccaaccagaacaccaaguucacccccgucggggugauccaggacggcgggacgacccaccggaacgagccccagcagugggugcugcccuccuacagcggccgcaacacccacaacguccaccucgcgccggccguggcccccaccuuccccggggagcagcugcuguucuuccgguccacgaugcccggcugcagcggcuacccgaacauggaccucgacugccugcugccccaggagugggugcaguacuucuaccaggaggccgcgcccgcccaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcguguga

SEQ ID NO: 11441 - RNA, 1620 nt, Artificial Sequence
  derived and/or modified sequence opt1 from VP1__Norovirus_and/or_Norovirus-like__KF008240
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccacgccccuggagaagcuguucaccggcccguccagcgccuucgucgugcagccccagaacgggcgcugcaccaccgacggcgugcuccuggggaccacccagcucucccccgucaacaucugcacguuccggggcgacgugacccacaucaccggcagccgcaacuacaccaugaaccuggccucccagaacuggaacaacuacgacccgacggaggagauccccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggucaaccagaacaccaaguucacgcccgugggggugauccaggacggcgggaccacccaccgcaacgagccccagcaguggguccugcccuccuacagcggccggaacacccacaacgugcaccucgccccggccguggcgcccacguuccccggggagcagcugcuguucuuccgcuccaccaugcccggcugcagcggcuacccgaacauggaccucgacugccugcugccccaggaguggguccaguacuucuaccaggaggccgcccccgcccaguccgacguggcgcuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacgcuggcccccauggggaacggcaccggccgccgccggguguga

SEQ ID NO: 11442 - RNA, 1620 nt, Artificial Sequence
  derived and/or modified sequence opt1 from VP1__Norovirus_and/or_Norovirus-like__KX354125
augaagauggccagcuccgacgccaaccccagcgacggcuccgcggccaaccuggugccggaggccaacaacgaggucauggcccucgagcccguggugggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgcgaugcucuacacgccccugcgggccaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccgggccgacggcagcacgcgcgggcacaaggccaccguguacaccggcagcgccgacuucuccccgaagcugggccggguccaguucgagaccgacacggaccacgacuucgaggccaaccagaacaccaaguucacccccgugggggugauccaggacggcagcaccacgcaccgcaacgagccccagcaguggguccugcccuccuacagcgggcggaacacccacaacgugcaccucgcgccggccguggcccccaccuuccccggcgagcagcugcuguucuuccgcuccaccaugcccgggugcagcggcuacccgaacauggaccucgacugccugcugccccaggaguggguccaguacuucuaccaggaggccgcgcccgcccaguccgacguggcccuccugcgguucgugaaccccgacacgggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggaccggccgcaagcgcguguga

SEQ ID NO: 11443 - RNA, 1620 nt, Artificial Sequence
  derived and/or modified sequence opt1 from VP1__Norovirus_and/or_Norovirus-like__KX354094
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccggguguga

SEQ ID NO: 11444 - RNA, 1620 nt, Artificial Sequence
  derived and/or modified sequence opt1 from VP1__Norovirus_and/or_Norovirus-like__KX354058
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucgccggcagccgcaacuacaccaugaaccuggccucccagaacuggaacaacuacgacccgaccgaggagauccccgcgccccuggggacccccgacuucgugggcaagauccaggggaugcucacgcagaccacccggaccgacggcagcacgcgcgggcacaaggccaccgucuacaccggcagcgccgaguucgccccgaagcugggccgggugcaguucgagaccgacacggaccacgacuucgagaccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgggucuga

SEQ ID NO: 11445 - RNA, 1620 nt, Artificial Sequence
  derived and/or modified sequence opt1 from VP1__Norovirus_and/or_Norovirus-like__KX354057
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcagcgccgaguucgccccgaagcugggccgggugcaguucgagacggacaccgaccacgacuucgagaccaaccagaacaccaaguucacgcccgugggggucauccaggacggcuccaccacccaccgcaacgagccccagcagugggugcugcccagcuacuccgggcggaacacccacaacgugcaccucgccccggccgucgcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacguggcgcuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacgcuggcccccaugggcaacgggaccggccgccgccgggucuga

SEQ ID NO: 11446 - RNA, 1620 nt, Artificial Sequence
  derived and/or modified sequence opt1 from VP1__Norovirus_and/or_Norovirus-like__KX354034
augaagauggccagcuccgacgccaaccccagcgacggcuccgcggccagccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccggguguga

SEQ ID NO: 11447 - RNA, 1620 nt, Artificial Sequence
  derived and/or modified sequence opt1 from VP1__Norovirus_and/or_Norovirus-like__KX354027
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccgcaacuacaccaugaaccuggccucccagaacuggaacaacuacgacccgacggaggagauccccgcgccccugggggcccccgacuucgugggcaagauccaggggaugcucacccagaccacccgggccgacggcagcacgcgcgggcacaaggccaccgucuacaccggcagcgccgacuucgccccgaagcugggccgggugcaguucgagaccgacacggaccacgacuucgaggcgaaccagaacaccaaguucacccccgugggggucauccaggacggcuccaccacgcaccgcaacgagccccagcagugggugcugcccagcuacuccgggcggaacacccacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcgcccaugggcaacggggccggccgccgccgggucuga

SEQ ID NO: 11448 - RNA, 1620 nt, Artificial Sequence
  derived and/or modified sequence opt1 from VP1__Norovirus_and/or_Norovirus-like__KX354025
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccgggccgacggcagcacgcgcgggcacaaggccaccguguacaccggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgcgccggccguggcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccggguguga

SEQ ID NO: 11449 - RNA, 1620 nt, Artificial Sequence
  derived and/or modified sequence opt1 from VP1__Norovirus_and/or_Norovirus-like__KJ685406
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccggguguga

SEQ ID NO: 11450 - RNA, 1620 nt, Artificial Sequence
  derived and/or modified sequence opt1 from VP1__Norovirus_and/or_Norovirus-like__KF008241
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucagcaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggaugcucacccagaccacccgggccgacggcagcacgcgcgggcacaaggccaccgucuacaccggcuccgccgacuucgccccgaagcugggccgggugcaguucgagaccgacacggaccacgacuucgaggccaaccagaacaccaaguucacccccgugggggucauccaggacggcagcaccacgcaccgcaacgagccccagcagugggugcugcccuccuacagcgggcggaacacccacaacgugcaccucgcgccggccgucgcccccaccuuccccggcgagcagcugcuguucuuccgcuccaccaugcccgggugcagcggcuacccgaacauggaccucgacugccugcugccccaggagugggugcaguacuucuaccaggaggccgcgcccgcccaguccgacguggcccuccugcgguucgucaaccccgacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgggucuga

SEQ ID NO: 11451 - RNA, 1620 nt, Artificial Sequence
  derived and/or modified sequence opt1 from VP1__Norovirus_and/or_Norovirus-like__AB504327
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccgguccgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacacccgcuucacgcccgucggcgugauccaggacgggggcaccacccaccggaacgagccccagcagugggugcuccccuccuacagcgggcgcaacgucccgaacgugcaccuggcccccgccguggcgcccaccuuccccggcgagcagcuccucuucuuccgguccacgaugccgggcugcagcggguaccccaacauggaccuggacugccugcucccccaggaguggguccagcacuucuaccaggaggccgcccccgcccaguccgacguggcgcugcugcgcuucgugaacccggacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgcguguga

SEQ ID NO: 11452 - RNA, 1620 nt, Artificial Sequence
  derived and/or modified sequence opt1 from VP1__Norovirus_and/or_Norovirus-like__KY424329
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaacuuccggggcgacgugacccacaucacgggcagccgcaacuacaccaugaaccuggccucccagaacuggaacaacuacgacccgaccgaggagauccccgcgccccuggggacccccgacuucgucggcaagauccaggggaugcucacgcagaccacccggaccgacggcagcacgcgcgggcacaaggccaccguguacaccggcagcgccgacuucgccccgaagcugggccgggugcaguucgagaccgacacggaccacgacuucgaggccaaccagaacaccaaguucacccccgucggggugauccaggacggcuccaccacgcaccgcaacgagccccagcagugggugcugcccagcuacuccgggcggaacacccacaacguccaccucgccccggcgguggcccccaccuuccccggcgagcagcugcuguucuuccgcagcaccaugcccgggugcuccggcuacccgaacauggaccucgacugccugcugccccaggagugggugcaguacuucuaccaggaggccgcccccgcgcagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggaccggccgccgccggguguga

SEQ ID NO: 11453 - RNA, 1620 nt, Artificial Sequence
  derived and/or modified sequence opt1 from VP1__Norovirus_and/or_Norovirus-like__KT780389
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggguccucacgcagaccacccgggccgacggcagcacccgcgggcacaaggccacgguguacaccggcagcgccgacuucgccccgaagcugggccgggugcaguucgagaccgacaccgaccacgacuucgaggcgaaccagaacacgaaguucacccccgucggggugauccaggacggcuccaccacccaccgcaacgagccccagcagugggugcugcccagcuacuccgggcggaacacgcacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucacgguggcccacaccggccagcacgaccuggugaucccgcccaacggguacuuccgguucgacagcugggucaaccaguucuacacccuggcgcccaugggcaacggggccggccgcaagcgcguguga

SEQ ID NO: 11454 - RNA, 1620 nt, Artificial Sequence
  derived and/or modified sequence opt1 from VP1__Norovirus_and/or_Norovirus-like__KX354134
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccauccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacaucacgcacaucaccggcucccacaacuacaccaugaaccuggccagccagaacuggaacagcuacgaccccaccgaggagaucccggcgccccuggggacgcccgacuucgugggcaagauccagggggugcucacccagaccacccgcgccgacggcuccacgcgggggcacaaggccaccgucuacaccggcagcgccgacuucgcccccaagcugggccgcgugcaguucgagaccgacacgaaccacgacuucgaggccaaccagaacaccaaguucaccccggugggggucauccaggacggcuccaccacgcaccggaacgagccccagcagugggugcugcccagcuacuccgggcgcaacacccacaacgugcaccucgcgcccgccgucgccccgaccuuccccggcgagcagcugcuguucuuccggagcaccaugcccgggugcuccggcuaccccaacauggaccucgacugccugcugccgcaggagugggugcaguucuucuaccaggaggccgcgcccgcccagagcgacguggcccuccugcgcuucgucaaccccgacacgggccgggugcuguucgagugcaagcuccacaaguccggguacgugaccgucgcccacaccggccagcacgaccuggugaucccgcccaacggguacuuccgcuucgacagcugggugaaccaguucuacacccuggcccccaugggcaacgggaccggccggcgccgcgucuga

SEQ ID NO: 11455 - RNA, 1620 nt, Artificial Sequence
  derived and/or modified sequence opt1 from VP1__Norovirus_and/or_Norovirus-like__KX354126
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccgggccgacggcagcacgcgcgggcacaaggccaccgucuacaccggcagcgccgacuucuccccgaagcugggccgggugcaguucgagaccgacacggaccacgacuucgaggccaaccagaacaccaaguucacccccgugggggucauccaggacggcagcaccacgcaccgcaacgagccccagcagugggugcugcccuccuacagcgggcggaacacccacaacgugcaccucgccccggcggucgcccccaccuuccccggcgagcagcugcuguucuuccgcuccaccaugcccgggugcagcggcuacccgaacauggaccucgacugccugcugccccaggagugggugcaguacuucuaccaggaggccgcccccgcgcaguccgacguggcccuccugcgguucgucaaccccgacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgcaagcgcgucuga

SEQ ID NO: 11456 - RNA, 1620 nt, Artificial Sequence
  derived and/or modified sequence opt1 from VP1__Norovirus_and/or_Norovirus-like__KR904237
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcgacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaugaucguggacgugcggcagcuggagcccguccucaucccgcugcccgacgugcgcaacaacuucuaccacuacaaccaguccaacgaccccacccugaagcucaucgccaugcuguacacgccccugcgggcgaacaacgccggcgacgacguguucaccgucagcugccgcgugcucacccggccgucccccgacuucgacuucaucuuccuggugccgcccaccgucgagagccgcaccaagcccuucuccgugcccgugcugacggucgaggagaugaccaacagccgguuccccaucccccucgagaagcuguucaccggcccguccagcgccuucgugguccagccccagaacgggcgcugcaccacggacggcgugcugcucgggaccacccagcugucccccgugaacaucugcaccuuccggggcgacgucacgcacaucaccggcagccgcaacuacaccaugaaccuggccucccagaacuggaacaacuacgacccgaccgaggagauccccgcgccccucggggcccccgacuucgugggcaagauccaggggaugcugacgcagaccacccggaccgacggcagcacgcgcgggcacaaggccaccguguacaccggcagcgccgacuucgccccgaagcugggccggguccaguucgagaccgacacggaccacgacuucgaggccaaccagaacaccaaguucacccccgugggggugauccaggacggcuccaccacgcaccgcaacgagccccagcaguggguccuccccagcuacuccgggcggaacacccacaacgugcaccuggcgccggccguggcccccaccuuccccggcgagcagcuccuguucuuccgcagcaccaugcccgggugcuccggcuacccgaacauggaccuggacugccugcucccccaggaguggguccaguacuucuaccaggaggccgcgcccgcccagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacgggaccggccgccgccggaucuga

SEQ ID NO: 11457 - RNA, 1620 nt, Artificial Sequence
  derived and/or modified sequence opt1 from VP1__Norovirus_and/or_Norovirus-like__KP241911
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgggucuga

SEQ ID NO: 11458 - RNA, 1620 nt, Artificial Sequence
  derived and/or modified sequence opt1 from VP1__Norovirus_and/or_Norovirus-like__KJ685411
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcugcuggggaccacccagcucucccccgucaacaucugcaccuuccggggcgacgugacgcacaucaccggcagccgcaacuacaccaugaaccuggccucccugaacuggaacaacuacgacccgaccgaggagauccccgcgccccucgggacgcccgacuucgugggcaagauccaggggaugcugacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcuccccagcuacuccgggcggaacacccacaacgugcaccuggccccggcggucgcccccaccuuccccggcgagcagcuccucuucuuccgcagcacgaugcccgggugcuccggcuacccgaacauggaccuggacugccugcucccccaggagugggugcaguacuucuaccaggaggccgcccccgcgcagagcgacguggcccugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacgggacgggccgccgccgggucuga

SEQ ID NO: 11459 - RNA, 1620 nt, Artificial Sequence
  derived and/or modified sequence opt1 from VP1__Norovirus_and/or_Norovirus-like__KF008242
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgcaagcgcguguga

SEQ ID NO: 11460 - RNA, 1620 nt, Artificial Sequence
  derived and/or modified sequence opt1 from VP1__Norovirus_and/or_Norovirus-like__KF060112
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccggaccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcuccaccacgcaccgcaacgagccccagcagugggugcugcccagcuacuccgggcggaacacccacaacgugcaccucgcgccggccgucgcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgggucuga

SEQ ID NO: 11461 - RNA, 1620 nt, Artificial Sequence
  derived and/or modified sequence opt1 from VP1__Norovirus_and/or_Norovirus-like__JX126912
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacagcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggggaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggcgccuucgugguccagccccagaacgggcgcugcaccaccgacggcgugcuccuggggaccacgcagcucucccccgucaacaucugcaccuuccggggcgacgugacccacaucgccggcacccacaacuacacgaugaaccuggccagccagaacuggaacaacuacgacccgaccgaggagauccccgcgccccuggggacccccgacuucgugggccgcauccaggggaugcucacccagacgacccggggcgacggguccacccgcggccacaaggccaccgucagcacgggcgacgugcacuucaccccgaagcugggguccauccaguucaacaccgacaccaacaacgacuucgagacgggccagaacaccaaguucacccccgugggggucauccaggacggcaacgggacccaccagaacgagccccagcagugggugcugcccagcuacagcggccggacgggccacaacgugcaccucgccccggccgucgcccccaccuuccccggggagcagcugcuguucuuccgcuccaccaugcccggcugcagcggguacccgaacaugaaccucgacugccugcugccccaggagugggugcagcacuucuaccaggaggccgcgcccgcccaguccgacguggcccuccugcgguucgucaaccccgacaccggccgcgugcuguucgagugcaagcuccacaagagcggguacgugaccgucgcccacacgggccagcacgaccuggugaucccgcccaacggcuacuuccgguucgacuccugggugaaccaguucuacacccuggcgcccauggggaacggcaccgggcgccggcgcgucuga

SEQ ID NO: 11462 - RNA, 1620 nt, Artificial Sequence
  derived and/or modified sequence opt1 from VP1__Norovirus_and/or_Norovirus-like__KX354143
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaucguguacaccggcuccgccgacuucgcccccaagcugggccgggugcaguucgagaccgacacggaccacgacuucgaggccaaccagaacaccaaguucaccccggucggggugauccaggacggcagcaccacgcaccgcaacgagccccagcagugggugcugcccuccuacagcgggcggaacacccacaacguccaccucgcccccgcgguggccccgaccuuccccggcgagcagcugcuguucuuccgcuccaccaugcccgggugcagcggcuaccccaacauggaccucgacugccugcugccgcaggagugggugcaguacuucuaccaggaggccgcccccgcgcaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccggguguga

SEQ ID NO: 11463 - RNA, 1620 nt, Artificial Sequence
  derived and/or modified sequence opt1 from VP1__Norovirus_and/or_Norovirus-like__KU985164
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccgggccgacggcagcacccgcgggcacaaggccacggucuacaccggcagcgccgacuucgccccgaagcugggccgggugcaguucgagaccgacaccgaccacgacuucgaggcgaaccagaacacgaaguucacccccgugggggucauccaggacggcuccaccacccaccgcaacgagccccagcagugggugcugcccagcuacuccgggcggaacacgcacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugacggucgcccacaccggccagcacgaccuggugaucccgcccaacggguacuuccgguucgacagcugggugaaccaguucuacacccuggcgcccaugggcaacggggccggccgccgccgggucuga

SEQ ID NO: 11464 - RNA, 1620 nt, Artificial Sequence
  derived and/or modified sequence opt1 from VP1__Norovirus_and/or_Norovirus-like__KX950760
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagguccuccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgacagcaccaucaagcucaucgccaugcuguacacgccccugcgggcgaacaacgccggcgacgacgucuucaccguguccugccgcgugcucacccggcccagcccggacuucgacuucaucuuccuggucccgcccaccguggagucccgcaccaagcccuucagcauccccgugcugacggucgaggagaugaccaacucccgguuccccaucccccucgagcgccuguucaccggccccagcuccgccuucgugguccagccgcagaacgggcggugcaccacggacggcgugcugcucgggaccacccagcugagccccgugaacaucugcaccuuccgcggcgacgucacgcacaucaccggcucccggaacuacaccaugaaccuggccagccagaacuggaacaacuacgaccccaccgaggagaucccggcgccccucgggacgcccgacuucgugggcaagauccaggggaugcugacccagaccacccgcgccaacggcagcacgcgggggcacaaggccaccguguacaccggcuccgccgacuucgcccccaagcugggccgcguccaguucgagaccgacacgagcgacgacuucgagaccucccagaacaccaaguucaccccggugggggugauccaggacggcagcacgacgccccggaacgagccccagcaguggguccuccccuccuacagcgggcgcaacacccacaacgugcaccuggccccggcgguggcccccaccuuccccggcgagcagcuccuguucuuccgguccaucaugcccgggugcagcggcuacccgaacauggaccuggacugccugcucccccaggaguggguccagcacuucuaccaggaggccgcccccgcgcaguccgacguggcccugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacgggaccggccgccggcgcguguga

SEQ ID NO: 11465 - RNA, 1620 nt, Artificial Sequence
  derived and/or modified sequence opt1 from VP1__Norovirus_and/or_Norovirus-like__KJ685402
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccggggccuucgucgugcagccccagaacggccgcugcaccacggacggggugcuccugggcaccacccagcucagccccgucaacaucugcaccuuccggggcgacgugacgcacaucaccgggucccgcaacuacaccaugaaccuggccagccagaacuggaacaacuacgacccgaccgaggagauccccgcgccccugggcacgcccgacuucguggggaagauccagggcaugcucacccagaccacccggacggacggguccacccgcggccacaaggccaccgucuacaccggcagcgccgacuucgccccgaagcuggggcgggugcaguucgagacggacaccgaccacgacuucgaggccaaccagaacaccaaguucacccccgugggcgucauccaggacgggagcacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgggucuga

SEQ ID NO: 11466 - RNA, 1620 nt, Artificial Sequence
  derived and/or modified sequence opt1 from VP1__Norovirus_and/or_Norovirus-like__KF060140
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacauccgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgaccccaccgaggagaucccggcgccccuggggacgcccgacuucgugggcaagauccaggggguccucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccggguguga

SEQ ID NO: 11467 - RNA, 1620 nt, Artificial Sequence
  derived and/or modified sequence opt1 from VP1__Norovirus_and/or_Norovirus-like__KX354132
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagcugaacgacuccaccaucaagcucaucgccaugcuguacacgccccugcgggcgaacaacgccggcgacgacguguucaccgugagcugccgcguccucacccggcccuccccggacuucgacuucaucuuccuggugccgcccaccguggagagccgcaccaagcccuucuccguccccauccugacgguggaggagaugaccaacagccgguuccccaucccccucgagaagcuguucaccggccccuccagcgccuucgugguccagccgcagaacgggcgcugcaccacggacggcgugcugcucgggaccacccagcugucccccgucaacaucugcaccuuccggggcgacaucacgcacaccaccggcagccacaacuacaccaugaaccuggccucccagaacuggaacagcuacgaccccacggaggagaucccggcgccccucgggacccccgacuucgugggcaagauccagggggugcugacccagaccacgcgcgccgacggcagcacccgggggcacaaggccaccgucuacaccggcuccgccgacuucgcccccaagcugggccgcgugcaguucgagacggacaccaaccacgacuucgaggccaaccagaacaccaaguucaccccggugggggucauccaggacggcgggacgacccaccggaacgagccccagcagugggugcuccccagcuacuccggccgcaacacccacaacgugcaccuggcgcccgccgucgccccgaccuuccccggggagcagcuccucuucuuccggagcacgaugcccggcugcuccggcuaccccaacauggaccuggacugccugcucccgcaggagugggugcaguucuucuaccaggaggccgcgcccgcccagagcgacguggcccugcugcgcuucgucaaccccgacaccgggcgggugcuguucgagugcaagcugcacaaguccggcuacgugaccgucgcccacaccgggcagcacgaccuggugaucccgcccaacggcuacuuccgcuucgacagcugggugaaccaguucuacacccucgcccccauggggaacggcacgggccggcgccgcgucuga

SEQ ID NO: 11468 - RNA, 1620 nt, Artificial Sequence
  derived and/or modified sequence opt1 from VP1__Norovirus_and/or_Norovirus-like__KX354006
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggaggugcccgcgccccuggggacgcccgacuucgucggcaagauccaggggaugcucacccagaccacccggacggacggcagcacccgcgggcacaaggccaccguguacaccggcagcgccgacuucacgccgaagcugggccggauccaguucgagaccgacaccgaccacgacuucgaggccaaccagaacaccaaguucacgcccgugggggucauccaggacggcuccaccacccaccgcaacgagccccagcagugggugcugcccagcuacuccgggcggaacacccacaacgugcaccucgccagcgccgucgcgccgacguuccccggcgagcagcugcuguucuuccgcuccaccaugcccgggugcagcggcuaccccaacauggaccucgacugccugcugccgcaggagugggugcaguacuucuaccaggaggccgcccccgcccaguccgacguggcgcuccugcgguucgucaaccccgacaccggccgcgugcuguucgagugcaagcuccacaagagcggguacgugaccgucgccuacaccggccagcacgaccuggugaucccgcccaacggguacuuccgguucgacuccugggugaaccaguucuacacgcuggcccccaugggcaacgggaccggccgccgccgggucuga

SEQ ID NO: 11469 - RNA, 1620 nt, Artificial Sequence
  derived and/or modified sequence opt1 from VP1__Norovirus_and/or_Norovirus-like__KX354145
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccggguguga

SEQ ID NO: 11470 - RNA, 1620 nt, Artificial Sequence
  derived and/or modified sequence opt1 from VP1__Norovirus_and/or_Norovirus-like__KX354140
augaagauggccagcuccgacgccagccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucucccccgugaacaucugcaccuuccggggcgacgugacgcacaucaccggcagccgcaacuacaccaugaaccuggccagccagaacuggaacaacuacgaccccaccgaggagaucccggcgccccuggccacgcccgacuucgucgggaagauccagggcaugcucacccagaccacccggacggacggguccacccgcggccacaaggccaccguguacaccgggagcgccgacuucgcccccaagcugggccgggugcaguucgagacggacaccgaccacgacuucgaggccaaccagaacaccaaguucaccccggucggcgugauccaggacggguccacgacccaccgcaacgagccccagcagugggugcugcccagcuacuccggccggaacacccacaacguccaccucgcgcccgccguggccccgaccuuccccggggagcagcugcuguucuuccgcagcacgaugcccggcugcuccggguaccccaacauggaccucgacugccugcugccgcaggagugggugcaguacuucuaccaggaggccgcgcccgcccagagcgacgucgcccuccugcgguucgugaaccccgacaccggccgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacggggcgccgccggguguga

SEQ ID NO: 11471 - RNA, 1620 nt, Artificial Sequence
  derived and/or modified sequence opt1 from VP1__Norovirus_and/or_Norovirus-like__KX354119
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccauccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacaucacgcacaucaccggcucccacaacuacaccaugaaccuggccagccagaacuggaacagcuacgaccccaccgaggagaucccggcgccccuggggacgcccgacuucgugggcaagauccagggggugcucacccagaccacccgcgccgacggcuccacgcgggggcacaaggccaccgucuacaccggcagcgccgacuucgcccccaagcugggccgcgugcaguucgagaccgacacgaaccacgacuucgaggccaaccagaacaccaaguucaccccggugggggucauccaggacggcgggaccacgcaccggaacgagccccagcagugggugcugcccuccuacagcggccgcaacacccacaacgugcaccucgcgcccgccgucgccccgaccuuccccggggagcagcugcuguucuuccgguccaccaugcccggcugcagcggcuaccccaacauggaccucgacugccugcugccgcaggagugggugcaguucuucuaccaggaggccgcgcccgcccaguccgacguggcccuccugcgcuucgucaaccccgacacggggcgggugcuguucgagugcaagcuccacaagcccggcuacgugaccgucgcccacaccgggcagcacgaccuggugaucccgcccaacggcuacuuccgcuucgacagcugggugaaccaguucuacacccuggcccccauggggaacggcaccggccggcgccgcgucuga

SEQ ID NO: 11472 - RNA, 1620 nt, Artificial Sequence
  derived and/or modified sequence opt1 from VP1__Norovirus_and/or_Norovirus-like__KX354018
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucggggccaaccagaacaccaaguucaccccggucggcgugauccaggacgggagcacgacccaccgcaacgagccccagcagugggugcugcccuccuacagcggccggaacacccacaacguccaccucgcccccgcgguggccccgaccuuccccggggagcagcugcuguucuuccgcuccacgaugcccggcugcagcggcuaccccaacauggaccucgacugccugcugccgcaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccggguguga

SEQ ID NO: 11473 - RNA, 1620 nt, Artificial Sequence
  derived and/or modified sequence opt1 from VP1__Norovirus_and/or_Norovirus-like__AB972499
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgacgacguguucaccgucuccugccgcgugcugacccggcccagcccggacuucgacuucaucuuccucgugccgcccaccgucgagucccgcaccaagcccuucagcgugcccgugcugacggucgaggagaugaccaacucccgguuccccaucccccuggagaagcuguucaccggccccagcuccgccuucgugguccagccgcagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcuccgccgacuucgcccccaagcugggccggguccaguucgagacggacaccgaccacgacuucgaggccaaccagaacaccaaguucaccccggugggggugauccaggacggcagcacgacccaccgcaacgagccccagcaguggguccugcccuccuacagcgggcggaacacccacaacgugcaccucgcccccgcgguggccccgaccuuccccggcgagcagcugcuguucuuccgcuccacgaugcccgggugcagcggcuaccccaacauggaccucgacugccugcugccgcaggaguggguccaguacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguguga

SEQ ID NO: 11474 - RNA, 1620 nt, Artificial Sequence
  derived and/or modified sequence opt1 from VP1__Norovirus_and/or_Norovirus-like__KF060142
augaagauggccagcuccgacgccaaccccagcgacggcuccgcggccaaccuggugccggaggucaacaacgaggugauggcccucgaccccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccggguguga

SEQ ID NO: 11475 - RNA, 1620 nt, Artificial Sequence
  derived and/or modified sequence opt1 from VP1__Norovirus_and/or_Norovirus-like__KF060138
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcaacgccuucgucgugcagccgcagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcagcgccgacuucgcccccaagcugggccgggugcaguucgagacggacaccgaccacgacuucgaggccaaccagaacaccaaguucaccccggucggggugauccaggacggcuccacgacccaccgcaacgagccccagcagugggugcugcccagcuacuccgggcggaacacccacaacguccaccucgcccccgcgguggccccgaccuuccccggcgagcagcugcuguucuuccgcagcacgaugcccgggugcuccggcuaccccaacauggaccucgacugccugcugccgcaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccggguguga

SEQ ID NO: 11476 - RNA, 1620 nt, Artificial Sequence
  derived and/or modified sequence opt1 from VP1__Norovirus_and/or_Norovirus-like__KP784697
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgacccgcccaacuucccgacggaggggcugucccccagccaggugaccauguucccccacaugaucgucgacgugcggcagcuggagcccgugcucaucccgcugcccgacguccgcaacaacuucuaccacuacaaccaguccaacgaccccacccugaagcucaucgccaugcuguacacgccccugcgggcgaacaacgccggcgacgacguguucaccgugagcugccgcguccucacccggccgucccccgacuucgacuucaucuuccuggugccgcccaccguggagagccgcaccaagcccuucuccguccccauccugacgguggaggagaugaccaacagccgguuccccaucccccucgagaagcuguucaccggcccguccagcgccuucgugguccagccccagaacgggcgcugcaccacggacggcgugcugcucgggaccacccagcugucccccgucaacaucugcaccuuccggggcgacaucacgcacaucaccggcagccgcaacuacaccaugaaccuggccucccagaacuggaacaacuacgacccgaccgaggagauccccgcgccccucgggacgcccgacuucgugggcaagauccaggggaugcugacccagaccacccggacggacggcagcacccgcgggcacaaggccaccguguacaccggcagcgccgacuucgccccgaagcugggccggguccaguucgagacggacaccgaccacgacuucgaggccaaccagaacaccaaguucacccccgugggggugauccaggacggcuccacgacccaccgcaacgagccccagcaguggguccuccccagcuacuccgggcggaacacccacaacgugcaccuggccccggcgguggcccccaccuuccccggcgagcagcuccuguucuuccgcagcacgaugcccgggugcuccggcuacccgaacauggaccuggacugccugcucccccaggaguggguccaguacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacgggacgggccgccgccggguguga

SEQ ID NO: 11477 - RNA, 1620 nt, Artificial Sequence
  derived and/or modified sequence opt1 from VP1__Norovirus_and/or_Norovirus-like__KF060111
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcgggacgacccaccgcaacgagccccagcagugggugcugcccagcuacuccggccggaacacccacaacguccaccucgcccccgcgguggccccgaccuuccccggggagcagcugcuguucuuccgcagcacgaugcccggcugcuccggcuaccccaacauggaccucgacugccugcugccgcaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccggguguga

SEQ ID NO: 11478 - RNA, 1620 nt, Artificial Sequence
  derived and/or modified sequence opt1 from VP1__Norovirus_and/or_Norovirus-like__KF060089
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccgucuacaccggcuccgccgacuucgcccccaagcugggccgggugcaguucgagacggacaccgaccacgacuucgaggccaaccagaacaccaaguucaccccggugggggucauccaggacggcagcacgacccaccgcaacgagccccagcagugggugcugcccuccuacagcgggcggaacacccacaacgugcaccucgcccccgcggucgccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggucuga

SEQ ID NO: 11479 - RNA, 1620 nt, Artificial Sequence
  derived and/or modified sequence opt1 from VP1__Norovirus_and/or_Norovirus-like__KP096333
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucaucguccagccccagaacgggcgcugcacgaccgacggcgugcuccuggggaccacccagcucucccccgucaacaucugcacguuccggggcgacgugacccacaucagcggcucccgcaacuacaccaugaaccuggccagccagaacuggaacagcuacgacccgaccgaggagacgcccgcgccccuggggacccccgacuucgugggcaagauccaggggguccucacccagaccacgcggaccgacggcuccacccgcgggcacaaggccaccguguacacgggcagcgccgacuucuccccgaagcugggccgggugcaguucgccaccgacaccgacaacgacuucgucaccaaccagaacacgaaguucacccccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagaccggguacgugacgguggcgcacaccggccagcacgaccuggucaucccgcccaacggguacuuccgguucgacagcugggugaaccaguucuacacccuggcccccaugggcaacgggaccggccgccgccggguguga

SEQ ID NO: 11480 - RNA, 1620 nt, Artificial Sequence
  derived and/or modified sequence opt1 from VP1__Norovirus_and/or_Norovirus-like__KF060153
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgagguggaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccggguguga

SEQ ID NO: 11481 - RNA, 1620 nt, Artificial Sequence
  derived and/or modified sequence opt1 from VP1__Norovirus_and/or_Norovirus-like__KF060125
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgagguggaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggacccucacccagaccacgcggaccgacggcagcacccgcgggcacaaggccaccguguacacgggcuccgccgacuucgcccccaagcugggccgggugcaguucgagaccgacaccgaccacgacuucgaggccaaccagaacaccaaguucacgccggucggggugauccaggacggcagcaccacccaccgcaacgagccccagcagugggugcugcccuccuacagcgggcggaacacccacaacguccaccucgcccccgcgguggccccgacguuccccggcgagcagcugcuguucuuccgcuccaccaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccggguguga

SEQ ID NO: 11482 - RNA, 1620 nt, Artificial Sequence
  derived and/or modified sequence opt1 from VP1__Norovirus_and/or_Norovirus-like__KX354135
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccauccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacaucacgcacaucaccggcucccacaacuacaccaugaaccuggccagccagaacuggaacagcuacgaccccaccgaggagaucccggcgccccuggggacgcccgacuucgugggcaagauccagggggugcucacccagaccacccgcgccgacggcuccacgcgggggcacaaggccaccgucuacaccggcagcgccgacuucgcccccaagcugggccgcgugcaguucgagaccgacacgaaccacgacuucgaggccaaccagaacaccaaguucaccccggugggggucauccaggacggcgggaccacgcaccggaacgagccccagcagugggugcugcccuccuacagcggccgcaacacccacaacgugcaccucgcgcccgccgucgccccgaccuuccccggggagcagcugcuguuccucaaguccaccaugcccggcugcagcggcuaccccaacauggaccuggacugccugcucccgcaggagugggugcaguucuucuaccaggaggccgcgcccgcccaguccgacguggcccugcugcgguucgucaaccccgacacggggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcaccggccgccggcgcgucuga

SEQ ID NO: 11483 - RNA, 1620 nt, Artificial Sequence
  derived and/or modified sequence opt1 from VP1__Norovirus_and/or_Norovirus-like__KX354045
augaagauggccagcuccgacgccaaccccagcgacggcuccgcggccaaccuggugccggacgucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucgugcucgccgggaacgccuucaccgccggcaagaucaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgacgacguguucaccgucuccugccgcgugcugacccggcccagcccggacuucgacuucaucuuccucgugccgcccaccgucgagucccgcaccaagcccuucagcgugcccgugcugacggucgaggagaugaccaacucccgguuccccaucccccuggagaagcuguucaccggccccagcuccgccuucgugguccagccgcagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcuccgccgacuucgcccccaagcugggccggguccaguucgagacggacaccgaccacgacuucgaggccaaccagaacaccaaguucaccccggugggggugauccaggacggcagcacgacccaccgcaacgagccccagcaguggguccugcccuccuacagcgggcggaacacccacaacgugcaccucgcccccgcgguggccccgaccuuccccggcgagcagcugcuguucuuccgcuccacgaugcccgggugcagcggcuaccccaacauggaccucgacugccugcugccgcaggaguggguccaguacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguguga

SEQ ID NO: 11484 - RNA, 1620 nt, Artificial Sequence
  derived and/or modified sequence opt1 from VP1__Norovirus_and/or_Norovirus-like__LC153121
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugauccacaucacgggcucccgcaacuacaccaugaaccuggccagccagaacuggaacaacuacgaccccaccgaggagaucccggcgccccuggggacccccgacuucgucggcaagauccaggggaugcucacgcagaccacccggaccgacggcagcacgcgcgggcacaaggccaccguguacaccggcuccgccgacuucgcccccaagcugggccgggugcaguucgagaccgacacggaccacgacuucgaggccaaccagaacaccaaguucaccccggucggggugauccaggacggcagcaccacgcaccgcaacgagccccagcagugggugcugcccuccuacagcgggcggaacacccacaacguccaccucgcccccgcgguggccccgaccuuccccggcgagcagcugcuguucuuccgcuccaccaugcccgggugcagcggcuaccccaacauggaccucgacugccugcugccgcaggagugggugcaguacuucuaccaggaggccgcccccgcgcaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccggguguga

SEQ ID NO: 11485 - RNA, 1620 nt, Artificial Sequence
  derived and/or modified sequence opt1 from VP1__Norovirus_and/or_Norovirus-like__KF668568
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccaucccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcggcgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccgggccguccagcgccuucgugguccagccccagaacggccgcugcaccacggacggggugcuccugggcaccacccagcucucccccgugaacaucugcaccuuccggggcgacgucacgcacaucaccgggagccgcaacuacaccaugaaccuggccucccagaacuggaacaacuacgacccgaccgaggagauccccgcgccccugggcacgcccgacuucguggggaagauccagggcaugcucacccagaccacccggacggacgggagcacccgcggccacaaggccaccguguacaccggcagcgccgacuucgccccgaagcuggggcggguccaguucgagacggacaccgaccacgacuucgaggccaaccagaucaccaaguucacccccaucggcgugauccaggacggguccacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccggguguga

SEQ ID NO: 11486 - RNA, 1620 nt, Artificial Sequence
  derived and/or modified sequence opt1 from VP1__Norovirus_and/or_Norovirus-like__KF668567
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucagcaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccaucggggugauccaggacggcagcacgacccaccgcaacgagccccagcaguggguccugcccuccuacagcgggcggaacacccacaacgugcaccucgccccggcgguggcccccaccuuccccggcgagcagcugcuguucuuccgcuccacgaugcccgggugcagcggcuacccgaacauggaccucgacugccugcugccccaggaguggguccaguacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguguga

SEQ ID NO: 11487 - RNA, 1620 nt, Artificial Sequence
  derived and/or modified sequence opt1 from VP1__Norovirus_and/or_Norovirus-like__KR904210
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccagaacuggaacagcuacgaccccaccgaggagaucccggcgccccuggagacgcccgacuucguggggaagauccagggcguccucacccagaccacccggacggacggguccacccgcggccacaaggccaccguguacaccgggagcgccgacuucucccccaagcugggccgggugcaguucgccacggacaccgacaacgacuucgacagcaaccagaacaccaaguucaccccggucggcgugauccaggacgggggcacgacccaccgcaacgagccccagcagugggugcugcccuccuacagcgggcgggacauccacaacguccaccucgcccccgccguggcgccgaccuuccccggcgagcagcugcuguucuuccgcuccaccaugcccgggugcagcggcuaccccaacauggaccucgacugccugcugccgcaggagugggugcaguacuucuaccaggaggccgcccccgcccaguccgacgucgcgcuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccggguguga

SEQ ID NO: 11488 - RNA, 1620 nt, Artificial Sequence
  derived and/or modified sequence opt1 from VP1__Norovirus_and/or_Norovirus-like__JX459907
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgaccccaccgacgagaucccggcgccccuggggacgcccgacuucgugggcaagauccaggggaugcucacccagaccacccggacggacggcagcacccgcgggcacaaggccaccgucuacaccggcuccgccgacuucgcccccaagcugggccgggugcaguucgagacggacaccgaccacgacuucgaggccaaccagaacaccaaguucaccccggugggggucauccaggacggcagcacgacccaccgcaacgagccccagcagugggugcugcccuccuacagcgggcggaacacccacaacgugcaccucgcccccgcggucgccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggucuga

SEQ ID NO: 11489 - RNA, 1620 nt, Artificial Sequence
  derived and/or modified sequence opt1 from VP1__Norovirus_and/or_Norovirus-like__KF060062
augaagauggccagcuccgacgccaaccccaccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcacgaagcccuucuccguccccgugcugaccguggaggagaugaccaacagccgguuccccaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacaucaccggcagccgcaacuacaccaugaaccuggccucccagaacuggaacaacuacgaccccacggaggagaccccggcgccccuggggacccccgacuucgucggcaagauccaggggaugcucacccagacgacccggaccgacggcagcacccgcgggcacaaggccacgguguacaccggcagcgccgacuucgcccccaagcugggccgggugcaguucgagaccgacaccgaccacgacuucgaggccaaccagaacacgaaguucaccccggucggggugauccaggacggcuccaccacccaccgcaacgagccccagcagugggugcugcccagcuacuccgggcggaacacgcacaacguccaccucgcccccgcgguggccccgaccuuccccggcgagcagcugcuguucuuccgcagcaccaugcccgggugcuccggcuaccccaacauggaccucgacugccugcugccgcaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacacgggccagcacgaccuggugaucccgcccaacggguacuuccgguucgacagcugggucaaccaguucuacacccuggcccccaugggcaacgggaccggccgccgccggguguga

SEQ ID NO: 11490 - RNA, 1620 nt, Artificial Sequence
  derived and/or modified sequence opt1 from VP1__Norovirus_and/or_Norovirus-like__KF060080
augaagauggccagcuccgacgccaaccccagcgacggcuccgcggccaaccuggugccggaggucaacaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgacagcaccaucaagcugaucgcgaugcucuacacgccccugcgggccaacaacgccggcgacgacguguucaccgucuccugccgcgugcugacccggcccagcccggacuucgacuucaucuuccucgugccgcccaccgucgagucccgcaccaagcccuucagcgugcccgugcugacggucgaggagaugaccaacucccgguuccccaucccccuggagaagcuguucaccggccccagcuccgccuucgugguccagccgcagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcuccgccgacuucgcccccaagcugggccggguccaguucgagacggacaccgaccacgacuucgaggccaaccagaacaccaaguucaccccggugggggugauccaggacggcagcacgacccaccgcaacgagccccagcaguggguccugcccuccuacagcgggcggaacacccacaacgugcaccucgcgcccgccguggccccgaccuuccccggcgagcagcugcuguucuuccgcuccacgaugcccgggugcagcggcuaccccaacauggaccucgacugccugcugccgcaggaguggguccaguacuucuaccaggaggccgcgcccgcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguguga

SEQ ID NO: 11491 - RNA, 1620 nt, Artificial Sequence
  derived and/or modified sequence opt1 from VP1__Norovirus_and/or_Norovirus-like__KF378731
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucccgaccgaggggcugucccccagccaggugacgauguucccccacaucaucgucgacgugcggcagcuggagcccgugcucaucccgcugcccgacguccgcaacaacuucuaccacuacaaccaguccaacgacagcaccaucaagcugaucgcgaugcucuacacgccccugcgggccaacaacgccggcgacgacguguucaccguguccugccgcguccugacccggcccagcccggacuucgacuucaucuuccucgugccgcccaccguggagucccgcaccaagcccuucagcguccccgugcugaccguggaggagaugacgaacucccgguuccccaucccccuggagaagcuguucaccggccccagcuccgccuucgucgugcagccgcagaacgggcgcugcaccaccgacggcguccugcuggggacgacccagcucagccccgugaacaucugcacccugcggggcgacgugacccacaucacgggcucccgcaacuacaccaugaaccuggccagccagaacuggaacaacuacgaccccaccgaggagaucccggcgccccucgggacccccgacuucgucggcaagauccaggggaugcugacgcagaccacccggaccgacggcagcacgcgcggguacaaggccaccguguacaccggcuccgccgacuucgcccccaagcugggccgggugcaguucgagaccgacacggaccacgacuucgaggccaaccagaacaccaaguucaccccggucggggugauccaggacggcagcaccacgcaccgcaacgagccccagcagugggugcuccccuccuacagcgggcggaacacccacaacguccaccuggcgcccgccguggccccgaccuuccccggcgagcagcuccucuucuuccgcuccaccaugcccgggugcagcggcuaccccaacauggaccuggacugccugcucccgcaggagugggugcaguacuucuaccaggaggccgcgcccgcccaguccgacgucgcccugcugcgguucgugaaccccgacacgggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacgggaccggccgccgccggguguga

SEQ ID NO: 11492 - RNA, 1620 nt, Artificial Sequence
  derived and/or modified sequence opt1 from VP1__Norovirus_and/or_Norovirus-like__AB933731
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagcaaggucucccccaucccccugaagaagcuguucaccggcccgagcuccgccuucgugguccagccccagaacgggcggugcacgaccgacggcgugcuccuggggaccacccagcucagccccgugaacaucugcacguuccgcggcgacgucacccacaucccgggcucccggaacuacaccaugaaccuggccagccagaacuggaacagcuacgaccccaccgaggagauccccgcgccccuggggacgccggacuucgugggcaagauccagggggugcucacccagaccacccgcacgaacggcuccacccgggggcacaaggccaccgucuacaccggcagcgccgacuucucccccaagcugggccgcgugcaguucgccacggacaccgacaacgacuucgagaccaaccagaacaccaaguucacgcccgugggggucauccaggacggcagcaccacgccccggaacgagccgcagcagugggugcugcccuccuacagcgggcgcaacauccacaacgugcaccucgcccccgccgucgcccccaccuucccgggcgagcagcugcuguucuuccgguccaccaugcccgggugcagcggcuaccccaacauggaccucgacugccugcugccccaggagugggugcaguacuucuaccaggaggcggccccggcccaguccgacguggcccuccugcgcuucgucaaccccgacaccggccgggugcuguucgagugcaagcuccacaagagcggguacgugaccgucgcgcacaccggccagcacgaccuggugaucccgcccaacggguacuuccgcuucgacuccugggugaaccaguucuacacccuggcccccaugggcaacgggacgggccggcgccgcuga

SEQ ID NO: 11493 - RNA, 1620 nt, Artificial Sequence
  derived and/or modified sequence opt1 from VP1__Norovirus_and/or_Norovirus-like__AB933749
augaagauggccagcaacgacgugaaccccuccgacggcagcaccgccaaccuggucccggaggugaacaacgaggugauggcgcucgagcccgucgugggggccgccaucgccgcccccguggcgggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggccgugguccggaucaucuucagcgcggugccgcccaacuucccgaccgagggccugucccccagccaggugaccauguucccccacaucaucgucgacgugcgccagcuggagcccgugcucaucccgcugcccgacguccggaacaacuucuaccacuacaaccaguccaacgacagcaccaucaagcugaucgccaugcucuacacgccccugcgcgccaacaacgccggggacgacguguucaccguguccugccggguccugacccgccccagcccggacuucgacuucaucuuccucgugccgcccaccguggagucccggacgaagcccuucagcguccccgugcugaccgucgaggagaugaccaacucccgcuuccccaucccccuggagaagcuguucaccggccccagcuccgccuucguggugcagccgcagaacggccggugcacgaccgacgggguccuccugggcaccacccagcucagccccgugaacaucugcacguuccgcggggacgugacccacaucuccggcagccggaacuacaccaugaaccuggcgagccagaacuggaacuccuacgaccccaccgaggagaucccggcgccccugggcacgcccgacuucgucgggaagauccagggcgugcucacccagaccacccgcacgaacgggagcacccggggccacaaggccaccguguacaccggguccgccgacuucagccccaagcugggccgcguccaguucgccacggacaccgacaacgacuucgagaccaaccagaacaccaaguucacgccggugggcgugauccaggacggguccaccacgccccggaacgagccccagcaguggguccugcccagcuacuccggccgcaacauccacaacgugcaccucgccccggccguggcccccaccuuccccggggagcagcugcuguucuuccggagcaccaugcccggcugcuccggguacccgaacauggaccucgacugccugcugccccaggaguggguccaguacuucuaccaggaggccgcccccgcgcagagcgacguggcccuccugcgcuucgugaaccccgacaccggccggguccuguucgagugcaagcuccacaaguccggcuacgugaccguggcccacaccgggcagcacgaccuggucaucccgcccaacggcuacuuccgcuucgacagcugggugaaccaguucuacacccuggcccccauggggaacggcacggggcgccggcgcuga

SEQ ID NO: 11494 - RNA, 1620 nt, Artificial Sequence
  derived and/or modified sequence opt1 from VP1__Norovirus_and/or_Norovirus-like__KC517370
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugcccuccaacuuccccacggaggggcugagcccgucccaggucaccauguucccccacaucaucguggacgugcggcagcuggagcccguccucaucccccugccggacgugcgcaacaacuucuaccacuacaaccagagcaacgacuccaccaucaagcugaucgccaugcucuacacccugcugcgggcgaacaacgccggcgacgacguguucacggucagcugccgcgugcucacccggcccucccccgacuucgacuucaucuuccuggugcccccgaccgucgagagccgcaccaagcccuucuccgugcccgugcugacggucgaggagaugaccaacagccgguuccccaucccgcucgagaagcuguucaccggccccuccagcgccuucgugguccagccccagaacgggcgcugcaccacggacggcgugcugcucgggaccacccagcugucccccgugaacaucugcaccuuccggggcgacgucacgcacaucaccggcagccgcaacuacaccaugaaccuggccagccagaacuggaacaacuacgacccgaccgaggagauccccgcgccccucgggacgccggacuucgugggcaagauccaggggaugcugacccagaccacccggacggacggcuccacccgcgggcacaaggccaccauguacaccggcagcgccgacuucgcccccaagcugggccgggugcaguucgagacggacaccgaccacgacuucgaggccaaccagaacaccaaguucacccccgucggggugauccaggacggcgggacgacccaccgcaacgagccccagcagugggugcucccguccuacagcggccggaacacccacaacguccaccuggcccccgcgguggcccccaccuuccccggggagcagcuccucuucuuccgcccgacgaugcccggcugcuccggcuaccccaacauggaccuggaccggcugcucccccaggagugggugcaguacuucuaccaggaggccgccccggcgcagagcgacgucgcccugcugcgcuucgugaaccccgacaccgggcgggugcuguucgagugcaagcugcacaaguccggcuacgucaccguggcccacaccgggcagcacgaccuggugaucccgcccaacggcuacuuccgcuucgacagcugggucaaccaguucuacacccucgccccgauggggaacggcacgggccgccggcgcguguga

SEQ ID NO: 11495 - RNA, 1620 nt, Artificial Sequence
  derived and/or modified sequence opt1 from VP1__Norovirus_and/or_Norovirus-like__EF547396
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgaggugccccucgaggacguccgcaacgugcuguuccacacgaacgacaaccggcccaccaugcgccuggugugcaugcucuacacgccccugcgggccaacggcagcuccagcggcaccgacccguucgucaucgccgggcgcgugcugaccugccccgacuccaacuucagcuuccucuuccuggugccgcccaacgucgagcagaagacccggcccuucuccgugcccaacaucccccugaacacccucagcaacucccgcgugcccagccugaucaaguccaugaccaucagccgggaccagaaccagaucauccaguuccagaacggccgcgucacgcuggacgggcagcuccagggcaccaccccgaccuccgugagccagcugugcaagauccggggcacgaccuaccacgcgaccgggggcaacgggaucaaccugaccgagcucaacggcgagcccuaccacgccuucgagagccccgcccccaucggguucccggaccugggcggcugcgacuggcaccugacggccacccccacccaggccuucaacgacggggcgaaggugguccgccucuccgugacccagggcgccgccuucgcgccccaccuggggacgauccacuacaccaccaccgacacggacuacagcccgaacaccuccaucaucugcacccuggacuggcucagccagaccacgggccaguccaacgucgaccccuggcagauccccaccuacgggagcacccugaccgaggccgcccagcuggcgcccccgaucuucccgcccggcuucggcgagacccucguguucuuccuguccgacuuccccaucagcaacgggaagaacggccuguccgugcccugcacgcucccccaggaguucgucacccacuucgugaacgagcaggcccccauccgcggggaggccgcccugcugcacuacguggaccccgacacccaccggaaccucggcgaguucaagcuguacccggagggguucaugaccugcguccccaacacgagcggcggcgggccccagacccugcccaucaacggcguguucguguucgucuccugggugagccgguucuaccagcucaagccgguggggaccgccggcgccgcccgccggcuguga

SEQ ID NO: 11496 - RNA, 1620 nt, Artificial Sequence
  derived and/or modified sequence opt1 from VP1__Norovirus_and/or_Norovirus-like__JN699047
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcaacgggaucaaccugaccgagcucaacggcgagcccuaccacgccuucgagagccccgcccccaucggguucccggaccugggcggcugcgacuggcaccugacggccacccccacccaggccuucaacgacggggcgaagguggugcgccucuccgucacccagggcgccgccuucgcgccccaccuggggacgauccacuacaccaccaccgaccacgacuacgacccgaacacgagcaucaucugcacccuggacuggcucucccagaccaccggccagaacaacguggaccccuggcagauccccacguacgggagcacccugaccgaggccgcccagcuggcgcccccgaucuucccgcccggcuucggcgagacccucgucuucuuccuguccgacuuccccaucagcaacgggaagaacggccuguccgugcccugcacccucccccaggaguucgugacgcacuucgucaacgagcaggcccccauccgcggggaggccgcccugcugcacuacguggaccccgacacccaccggaaccucggcgaguucaagcuguacccggagggguucaugaccugcgugcccaacaccagcggcggcgggccccagacgcugcccaucaacggcgucuucguguucguguccugggucagccgguucuaccagcucaagccgguggggaccgccggcgccgcccgccggcuguga

SEQ ID NO: 11497 - RNA, 1620 nt, Artificial Sequence
  derived and/or modified sequence opt1 from VP1__Norovirus_and/or_Norovirus-like__KT781411
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccagccagaacaucuccaucgcccaggccaccauguucccccacgucaucgccgacgugcgcgugcuggagcccaucgaggucccccucgaggacgugcggaacgugcuguuccacaacaacgacaacagccccaccaugcgccuggucugcaugcucuacacgccccugcgggcguccggcagcuccagcggcaccgacccguucgugaucgccgggcgcgugcugaccugccccucccccgacuucagcuuccucuuccuggugcccccgaacgucgagcagaagaccaagcccuucuccgugcccaaccugccccucaacacgcugagcaacucccgggucccgagccugaucaacgccaugaugaucucccgcgaccacggccagauggugcaguuccagaacgggcgggugacccucgacggccagcugcagggcaccacccccacgagccugagccagcucugcaagauccgcgggaaggucuuccuggccuccggcgggaacggccugaaccucaccgagcuggacgggagcgccuaccacgcguucgagucccccgcccccaucggcuucccggacaucggcgacugcgacuggcacaugaacgccaccgccaccagcaacuucacgggguccaacgacgagcaccagauccuggugaagcaggagagcaccuucgcgccccaccucggccacgugcaggccgaccaccuccccgaggucgccaacaccgaccugauggugucccugagcuggaucuccccggucagcgaccagcaccggcgcgacguggaccccugggugaucccccgguacggguccacccugacggaggccgcccagcuggcgcccccgaucuacccgcccggcuucggggaggccaucgucuucuucaugagcgacuuccccgugguguccggcgucaacggcaugcgcauccccugcacccucccccaggaguacguggcccacuucgugaacgagcaggcccccacccgcggggaggccgcgcugcugcacuacgucgaccccgacacccaccggaaccucggcgaguucaagaucuacccggagggguucaugacgugcgugcccaacagcuccggcaccgggccccagacccugcccaucaacggcguguucaccuucgucagcugggugucccgguucuaccagcugaagccggugggcacggccgggcccgcccgccggcucuga

SEQ ID NO: 11498 - RNA, 1620 nt, Artificial Sequence
  derived and/or modified sequence opt1 from VP1__Norovirus_and/or_Norovirus-like__U04469
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucauguccaacuacgugcaggccccgcagggggaguucaccaucagccccaacaacacgcccggcgacauccucuucgaccugcagcugggcccccaccucaacccguuccugucccaccuggcccagauguacaacgggugggucggcaacaugcgcgugaaggugcuccuggccgggaacgccuucaccgcgggcaagaucaucaucagcugcaucccgcccggguucgccgcccagaacaucuccaucgcccaggccaccauguucccccacgucaucgcggacgugcgggugcuggagcccaucgaggucccccucgaggacgugcgcaacgugcuguuccacaacaacgacagcucccccaccaugcggcuggucugcaugcucuacacgccccugcgcgccagcggcuccagcuccggcaccgacccguucgugaucgccgggcgggugcugaccugccccagccccgacuucuccuuccucuuccuggugcccccgaacgucgagcagaagaccaagcccuucagcgugcccaaccugccccucaacacgcuguccaacagccgcgucccgucccugaucaacgccaugaugaucagccgggaccacggccagauggugcaguuccagaacgggcgcgugacccucgacggccagcugcagggcaccacccccacgagccugucccagcucugcaagauccgggggaaggucuuccacgccagcggcgggaacggccugaaccugaccgagcucgacggguccgcguaccacgccuucgagagccccgcccccaucggcuucccggacaucggcgacugcgacuggcacauguccgccaccgccaccaacaacuucacggggagcuccaacgaguaccagauccugaucaagcaggagagcgcguucgcgccccaccugggccacgugcaggccgacaaccucuccgccggggccaacaccgaccugaucgugagccuguccuggaucagccccgucuccgaccagcaccgccacgacguggacccgugggucaucccccgguacggcagcucccucaccgaggccgcccagcuggccccgcccaucuacccgcccggguucggcgaggccaucguguucuucaugagcgacuuccccguggucuccggcgugaacgggaugcgcauccccugcacccugccccaggaguacguggcgcacuucgucaacgagcaggcccccacgcggggcgaggccgcccuccugcacuacguggaccccgacacccaccgcaaccugggggaguucaagauguaccccgagggcuucaugaccugcgugccgaacagcuccgggagcggcccccagacccuccccaucaacggcgucuucacguucgugagcugggugucccgguucuaccagcugaagcccgucgggaccgccggcccggcgcgccggcuguga

SEQ ID NO: 11499 - RNA, 1620 nt, Artificial Sequence
  derived and/or modified sequence opt1 from VP1__Norovirus_and/or_Norovirus-like__JN699049
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccagccagaacaucuccaucgcccaggccaccauguucccccacgucaucgccgacgugcgcgugcuggagcccaucgaggucccccucgaggacgugcggaacgugcuguuccacaacaacgacaacacccccacgaugcgccuggucugcaugcucuacacgccccugcgggcgagcggcuccagcuccggcaccgacccguucgugaucgccgggcgcgugcugaccugccccagccccgacuucuccuuccucuuccuggugcccccgaacgucgagcagaagaccaagcccuucagcgugcccaaccugccccucaacguccuguccaacagccgggugccgucccugaucaaguucaugauggugagccaggaccacggccagaugguccaguuccagaacgggcgcgugacccucgacggccagcugcagggcaccacccccacguccgccagccagcugugcaagaugcgggggaccguguaccacgccagcggcgggcagggccucaaccugaccgagaucgacgggacccccuaccacgccuucgagucccccgcgccgaucggcuuccccgaccugggcgacagcgacuggcacaucaacgccucccccgccacgaccuucaacaccggggagagcgucaagcgccucgacauggagcagggcuccagcuucgccccgcaccuggggaccgugcacuacacgaacgccgacuacgacgcgaacaccgaccugaucugcucccucgaguggcugagcccgcccuccggcgggacccccaacaaggucaaccccugggccaucccccgguacggcagcacccugacggaggccgcccagcucgcgccgcccaucuacccgcccggcuucggggaggccaucguguucuucauguccgacuuccccaucgccaacggccaggacgggcugaaggugcccugcaccaucccccaggaguucgucacccacuucgugaacgagcaggcccccacccgcggcgaggccgcgcugcuccacuacguggaccccgacacgcaccggaaccugggggaguucaagcuguaccccgagggcuucaugaccugcgucccgaacagcuccggcagcgggccccagacccuccccaucaacggcguguucaccuucguguccugggucagccgcuucuaccagcugaagcccguggggacgaccggcccggugcggcgccuguga

SEQ ID NO: 11500 - RNA, 1620 nt, Artificial Sequence
  derived and/or modified sequence opt1 from VP1__Norovirus_and/or_Norovirus-like__GQ856473
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacucccccaccaugcgccuggucugcaugcucuacacgccccugcgggccagcggcuccagcuccggcaccgacccguucgugaucgccgggcgcgugcugaccugccccagccccgacuucuccuuccucuuccuggugcccccgaacgucgagcagaagaccaagcccuucagcgugcccaaccugccccucaacacgcuguccaacagccgggucccgucccugaucaacgccaugaugaucagccgcgaccacggccagauggugcaguuccagaacgggcgggugacccucgacggccagcugcagggcaccacccccacgucccugagccagcucugcaagauccgcgggaaggucuuccacgccagcggcgggaacggccugaaccugaccgagcucgacggguccgcguaccacgccuucgagagccccgcccccaucggcuucccggacaucggcgagugcgacuggcacaugaacgccaccgccaccuccaacuucacggggagcaacgacgaguaccagauccuggugaagcaggaguccaccuucgcgccccaccugggccacgugcaggccgacagccucuccgccgacgccaacaccgaccugauggucagccuguccuggaucagccccguguccgaccagcaccggcgcgacgucgacccgugggugaucccccgguacgggagcucccucaccgaggcggcccagcuggccccgcccaucuacccgcccggcuucggggaggccaucguguucuucaugagcgacuuccccgucguguccggcgugaacggcaugcgcauccccugcacgcugccccaggaguacgucgcccacuucgugaacgagcaggcgcccacccgcggggaggccgcccuccugcacuacguggaccccgacacccaccggaaccugggcgaguucaagauguaccccgagggguucaugaccugcgucccgaacagcuccggcagcgggccccagacgcuccccaucaacggcgugcugaccuucguguccugggucagccgguucuaccagcugaagcccgugggcaccgccgggccggcccgccggcucuga

SEQ ID NO: 11501 - RNA, 1620 nt, Artificial Sequence
  derived and/or modified sequence opt1 from VP1__Norovirus_and/or_Norovirus-like__JN699050
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccagccagaacaucuccaucgcccaggccaccauguucccccacgucaucgccgacgugcgcgugcuggagcccaucgaggucccccucgaggacgugcggaacgugcuguuccacaacaacgacaacacccccacgaugcgccuggucugcaugcucuacacgccccugcgggcgagcggcuccagcuccggcaccgacccguucgugaucgccgggcgcgugcugaccugccccagccccgacuucuccuuccucuuccuggugcccccgaacgucgagcagaagaccaagcccuucagcgugcccaaccugccccucaacguccuguccaacagccgggugccgucccugaucaagagcaugauggugucccaggaccacggccagaugguccaguuccagaacgggcgcgugacccucgacggccagcugcagggcaccacccccacgagcgccagccagcugugcaagaugcgggggaccguguaccacgccuccggcgggcagggccucaaccugaccgagaucgacgggacccccuaccacgccuucgagagccccgcgccgaucggcuuccccgacaucggcgacuccgacuggcacaucaacgccagccccgccacgaccuucgacuccggggagagcaucaagcgccuggacauggagcagggcuccagcuucgccccgcaccucgggaccguccacuacaccaacgccgacuaccccgcgaacacggaccugaucugcucccuggaguggcucagcccgcccuccggcgggacccccaacaaggugaaccccuggaccaucccccgguacggcagcacccugacggaggccgcccagcuggcgcccccgaucuacccgcccggcuucggggaggccaucgucuucuucauguccgacuuccccaucgccaacggccaggacgggcucaaggugcccugcaccaucccccaggaguucgugacccacuucgucaacgagcaggcccccacccgcggcgaggccgcccugcugcacuacguggaccccgacacgcaccggaaccucggggaguucaagcuguacccggagggcuucaugaccugcgugcccaacagcuccggcagcgggccccagacccugcccaucaacggcgucuucaccuucguguccugggugagccgcuucuaccagcucaagccggucgggacgaccggccccgugcggcgccuguga

SEQ ID NO: 11502 - RNA, 1620 nt, Artificial Sequence
  derived and/or modified sequence opt1 from VP1__Norovirus_and/or_Norovirus-like__GQ856472
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcagcgggaucaaccugaccgagcucaacggcgagcccuaccacgccuucgagucccccgcccccaucggguucccggaccugggcggcugcgacuggcaccugacggccacccccacccaggccuucaacgacggggcgaagguggugcgccucagcgucacccagggcgccgccuucgcgccccaccuggggacgauccacuacaccaccaccgacacggacuacaacccgaacaccuccaucaucugcacccuggacuggcucagccagaccacgggccaguccaacguggaccccuggcagauccccaccuacgggagcgcccugaccgaggccgcccagcuggcgcccccgaucuucccgcccggcuucggcgagacccucgucuucuuccuguccgacuuccccaucagcaacgggaagaacggccuguccgugcccugcacccucccccaggaguucgugacgcacuucgucaacgagcaggcccccauccgcggggaggccgcccugcugcacuacguggaccccgacacccaccggaaccucggcgaguucaagcuguacccggagggguucaugaccugcgugcccaacaccagcggcggcgggccccagacgcugcccaucaacggcgucuucguguucguguccugggucagccgguucuaccagcucaagccgguggggaccgccggcgccgcccgccggcuguga

SEQ ID NO: 11503 - RNA, 1620 nt, Artificial Sequence
  derived and/or modified sequence opt1 from VP1__Norovirus_and/or_Norovirus-like__GQ856471
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcagcgggaucaaccugaccgagcucaacggcgagcccuaccacgccuucgagucccccgcccccaucggguucccggaccugggcggcugcgacuggcaccugacggccacccccacccaggccuucaacgacggggcgaagguggugcgccucagcgucacccagggcgccgccuucgcgccccaccuggggacgauccacuacaccaccaccgacacggacuacaacccgaacaccuccaucaucugcacccuggacuggcucagccagaccacgggccaguccaacguggaccccuggcagauccccaccuacgggagcacccugaccgaggccgcccagcuggcgcccccgaucuucccgcccggcuucggcgagacccucgucuucuuccuguccgacuuccccaucagcaacgggaagaacggccuguccgugcccugcacgcucccccaggaguucgugacccacuucgucaacgagcaggcccccauccgcggggaggccgcccugcugcacuacgccgaccccgacacccaccggaaccucggcgaguucaagcuguacccggagggguucaugaccugcgugcccaacacgagcggcggcgggccccagacccugcccaucaacggcguguucgucuucguguccugggugagccgguucuaccagcucaagccggucgggaccgccggcgccgcccgccggcuguga

SEQ ID NO: 11504 - RNA, 1620 nt, Artificial Sequence
  derived and/or modified sequence opt1 from VP1__Norovirus_and/or_Norovirus-like__JQ911594
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcaacgggaucaaccugaccgagcucaacggcgagcccuaccacgccuucgagagccccgcccccaucggguucccggaccugggcggcugcgacuggcaccugacggccacccccacccaggccuucaacgacggggcgaagguggugcgccucuccgucacccagggcgccgccuucgcgccccaccuggggacgauccacuacaccaccaccgacacggacuacaacccgaacaccagcaucaucugcacccuggacuggcucucccagaccgccggccagagcaacguggaccccuggcagauccccacguacggguccacccugaccgaggccgcccagcuggcgcccccgaucuucccgcccggcuucggcgagacccucgucuucuuccugagcgacuuccccaucuccaacgggaagaacggccugagcgugcccugcacccucccccaggaguucgugacgcacuucgucaacgagcaggcccccauccgcggggaggccgcccugcugcacuacguggaccccgacacccaccggaaccucggcgaguucaagcuguacccggagggguucaugaccugcgugcccaacaccuccggcggcgggccccagacgcugcccaucaacggcgucuucguguucgugagcugggucucccgguucuaccagcucaagccgguggggaccgccggcgccgcccgccggcuguga

SEQ ID NO: 11505 - RNA, 1620 nt, Artificial Sequence
  derived and/or modified sequence opt1 from VP1__Norovirus_and/or_Norovirus-like__GU296356
augaugauggccagcaaggacgccaccuccaacauggacggcaccagcggggcgggccagcuggugcccgagaacaacaacacguccgagccgaucaacauggagcccgucgccggggccgugaccgccgccgcgaccgccggccaggugaacaugaucgaccccuggaucaugaacaacuacguccaggcgccccagggggaguucaccaucagcccgaacaacacgcccggcgacauccucuucgaccugcagcugggcccccaccucaaccccuuccuggcccaccugucccagauguacaacgggugggugggcaacaugaaggugcgcgucgugcucgccgggaacgccuucagcgccggcaagaucaucgugugcugcaucccgcccggguucuccgcccccaacaucagcaucgcccaggcgaccauguucccccacgucaucgccgacgugcgggugcuggagccgaucgacaucccccuggacgacguccgcaacgugcuguuccacaccaacgacaacggcaaccagaccaugcggcugcugugcaugcucuacacgccccugcgcuccggcgggaccagcuccggcaccgaccccuucgugaucgccgggcggguccugaccugcccgacgcccgacuucaacuuccucuuccuggugccgcccaccguggagcagaagaccaagcaguucagcguccccaaccugccccucaacgugauguccaacagccgcgugcccucccugcugaacgccauggucgugagccccgaccaggcccaggugguccaguuccagaacggccggugcacccucgacggccagaugcuggggacgaccaccguguccgcgagcugcgucgcccgcuuccggggcaagaccuuccaggccccggacgaccgccuggggaucaaccucgccgagaucuccggcgagcccuaccacgccuucgagagccccgcgccccugggguucccggacuucggcgacggcgacuggcacgugacggccaccaagguggcccccagccagcuggaggccaacgaccccgucgugguggggaacguccagccguacaacccccaguucgcgccccaccucggcacccuggugguggagaaccccaccccgaaccaggucgccacggggaccgaccuccucuucaacaucaccuggcuguccaaccgggccaacaaccgcuucaaccccuggaucauccccaacuacggcagcacccugacggaggccgcccagcucgcgcccuccaucuucccgcccggguucggcgagaccaucguguacuucaacagcaccuuccccgccgugggcgccaccacgcacgccgccauccccugccugcugccgcaggaguucgucgcgcacuucgugaacgagcaggcccccauccgcggggaggccgcccuccugcacuacaucgaccccgacacccaccggaaccugggcgaguucaagaucuaccccgagggguucgugaccugcgucccgaacgugggcgggaccggcccccagucccuccccacgaacggcaucuucguguucgucagcugggugucccgguacuaccagcugaagcccguggggaccgccuga

SEQ ID NO: 11506 - RNA, 1620 nt, Artificial Sequence
  derived and/or modified sequence opt1 from VP1__Norovirus_and/or_Norovirus-like__KM461693
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaacgcccgcgcggccgaccucaccgacuccccgcagcgggcccgcaaccacccccugcacgugcaggucaagaaccuggacgggacccaguacgaccccaccgacgacaucccggccgugcucggcgccaucgacuucaagggcacgguguucggggucgcgagccagcgggacguguccggcacccaggagcaggggcacuacgccacccgcgcccacgaggcccacaucgacaccacggaccccaaguacgcgcccaagcugggcaccauccugaucaagagcgaguccaccgacuucaccacgaaccagcccauccgguucaccccgguggggaugggcgacaacaacuggcgccagugggagcuccccgacuacagcggcagccugacccugaacaugaaccucgcccccgccgucucccccagcuucccgggggagcggauccuguucuuccgcuccaucgugcccagcgccggcggguacggcuccggguacaucgacugccugaucccccaggagugggugcagcacuucuaccaggaggccgcgcccagccaguccgccgucgcccucgugcgcuacgugaacccggacaccggccggaacaucuucgaggccaagcugcaccgcgagggcuuccugacggucgccaacagcgggaacaaccccaugggcgugccgcccaacggguacuuccgguucgaggcgugggugaaccaguucuacacccucgcccccuga

SEQ ID NO: 11507 - RNA, 1620 nt, Artificial Sequence
  derived and/or modified sequence opt1 from VP1__Norovirus_and/or_Norovirus-like__LC145789
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccccggccaucgacugccugcugccccaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgccgguggucgugcccgccaacggcuacuuccgcuucgacagcugggugaaccaguucuacucccucgcccccauggggaccggcaacgggcggcgcuga

SEQ ID NO: 11508 - RNA, 1617 nt, Artificial Sequence
  derived and/or modified sequence opt1 from VP1__Norovirus_and/or_Norovirus-like__KX171417
augaagauggccagcaacgacgccgcgcccuccaacgacggcgccgccgggcuggugccggagggcaacaacgagacccucagccuggagcccgucgccggggccgcgaucgccgcccccgugaccggccagaacaacaucaucgaccccuggauccgcacgaacuucgugcaggccccgaacggggaguucaccgucagcccccggaacucccccggcgagauccugcucaaccuggagcugggccccgaccucaacccguaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccccugccggacgugcgcaacaccuucuuccacuacaacaaccagcccaacucccggaugcgccuggucgccaugcucuacacgccccugcggagcaacggcuccggcgacgacguguucaccgugagcugccgcguccugacccggcccaccccggacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugcccuccggcaucugcgcguuccgcggccgggucaccgccaagaccgaccacagcgacaaguggcacaugcagcugcagaaccucaacgggacgaccuacgacccgaccgacgacgugcccgcgccccugggcaccccggacuucaaggggguggucuucggcguggccucccagcgcaacgucgggaacgacgcccccggcagcacgcgggcccacgaggccgugaucagcaccuacagcccccaguucgugcccaagcugggcuccgucaacuuccgcuccaacgacgacgacuuccagcuccagccgaccaaguucacccccgugugcaucaacgacgacgacgaccaccccuuccggcagugggagcugcccgacuacagcgggcugcucacgcugaacaugaaccuggccccgcccguggcccccaacuuccccggcgagcagcuccuguucuuccgcuccuucgucccgugcagcgggggcuacaaccaggggaucguggacugccugaucccccaggaguggauccagcacuucuaccaggaguccgcccccagccaguccgagguggcgcucauccgguacgucaaccccgacaccggccgcacccuguucgaggccaagcugcaccggagcggcuacaucaccguggcccacuccggggacuacccgcucgugguccccgccaacggcuacuuccgcuucgacagcugggugaaccaguucuacucccuggcgcccauggggacgggcaacgggcgccggcgcgcccaguga

SEQ ID NO: 11509 - RNA, 1617 nt, Artificial Sequence
  derived and/or modified sequence opt1 from VP1__Norovirus_and/or_Norovirus-like__KX171412
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgccgagaccgaccaccacgacaaguggcacaugcagcugcagaaccucaacgggacgaccuacgaccccaccgacgacgugcccgccccgcugggcacccccgacuucaaggggguggucuucggcguggccucccagcgcaacgucgggaacgacgcccccggcagcacgcgggcgcacgaggccgugaucuccaccuacagcccccaguucgugccgaagcugggcagcgucaacuuccgcuccaacgacgacgacuuccagcuccagcccaccaaguucacccccguggggaucaacgacgacggcgaccaccccuuccggcagugggagcugccggacuacagcgggcugcucacgcugaacaugaaccuggccccgcccguggcccccaacuuccccggcgagcagcuccuguucuuccgcuccuucguccccugcagcgggggcuacaaccagggcaucguggacugccugaucccccaggaguggauccagcacuucuaccaggaguccgcccccagccaguccgacguggcgcucauccgguacgucaacccggacaccgggcgcacccuguucgaggccaagcugcaccggagcggcuacaucaccguggcccacuccggggacuacccccucgugguccccgccaacggcuacuuccgcuucgacagcugggugaaccaguucuacucccuggcgcccauggggacgggcaacggccgccggcgcgcccaguga

SEQ ID NO: 11510 - RNA, 1617 nt, Artificial Sequence
  derived and/or modified sequence opt1 from VP1__Norovirus_and/or_Norovirus-like__KU557839
augaagauggccagcaacgacgccgcgcccuccagcgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacaacaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcguggccagccagcggaacgucgggaacgacgcccccggcuccacgcgcgcgcacgaggccgugaucagcaccuacagcccccaguucgugccgaagcugggcuccgucaacuuccggagcaacgacaacgacuuccagcuccagcccaccaaguucacccccguggggaucaacgacgacggcgaccaccccuuccgccagugggagcugccggacuacuccgggcugcucacgcugaacaugaaccuggccccgcccguggcccccaacuuccccggcgagcagcuccuguucuuccggagcuucguccccugcuccgggggcuacaaccagggcaucguggacugccugaucccccaggaguggauccagcacuucuaccaggagagcgcccccucccagagcgacguggcgcucauccgcuacgucaacccggacaccgggcggacccuguucgaggccaagcugcaccgcuccggcuacaucaccguggcccacagcggggacuacccccucgugguccccgccaacggcuacuuccgcuucgacuccugggugaaccaguucuacagccuggcgcccauggggacgggcaacggccggcgccgggcccaguga

SEQ ID NO: 11511 - RNA, 1617 nt, Artificial Sequence
  derived and/or modified sequence opt1 from VP1__Norovirus_and/or_Norovirus-like__KP902564
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcguggccucccagcggaacgucgggaacgacgcccccgacagcacgcgcgcgcacgaggccgugaucuccaccuacagcccccaguucgugccgaagcugggcagcgucaacuuccgguccaacgacaacgacuuccagcuccagcccaccaaguucacccccgugggcaucaacgacgacggggaccaccccuuccgccagugggagcugccggacuacagcggccugcucacgcugaacaugaaccuggccccgcccguggcccccaacuuccccggggagcagcuccuguucuuccgguccuucguccccugcagcggcggguacaaccagggcaucguggacugccugaucccccaggaguggauccagcacuucuaccaggaguccgcccccagccaguccgacguggcgcucauccgcuacgucaacccggacaccggccggacccuguucgaggccaagcugcaccgcagcggguacaucaccguggcccacuccggcgacuacccccucgugguccccgccaacggguacuuccgcuucgacagcugggugaaccaguucuacucccuggcgcccaugggcacggggaacggccggcgccgggcccaguga

SEQ ID NO: 11512 - RNA, 1617 nt, Artificial Sequence
  derived and/or modified sequence opt1 from VP1__Norovirus_and/or_Norovirus-like__KU587625
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccacaucaucgucgacgugcggacgcuggagcccaucaugaucccgcuccccgacgugcgcaacaccuucuuccacuacaacaaccagcccaacagccggaugcgccuggucgccaugcuguacacgccccuccgguccaacggcagcggcgacgacguguucaccguguccugccgcguccugacccggccgacccccgacuucgaguucaccuaccuggugccgcccagcguggaguccaagaccaagcccuucagccuccccauccugacgcuguccgagcucaccaacagccgcuuccccguccccaucgacucccuguucaccgcccagaacaacgugcuccaggugcagugccagaacgggcggugcacccucgacggcgagcugcaggggacgacccagcugcucccgagcggcaucugcgcguuccgcggccgggucaccgccgagaccgacaaccccgacaaguggcacaugcagcugcagaaccugaacgggacgaccuacgaccccaccgacgacgugccggcgccccucggcacccccgacuucaaggggguggucuucggcguggccucccagcgcaacgucgggaacgacgcccccggcagcacgcgggcccacgaggccgugaucuccaccuacagcccgaaguucgugcccaagcugggcagcgucaacuuccgcuccaacgacgacgacuuccagcugcagcccacccgguucacccccguggggaucaacgacgacggcaaccacccguuccgccagugggagcuccccgacuacagcggggugcugacgcugaacaugaaccucgccccgcccgucgcccccaacuuccccggcgagcagcugcugcuguuccgguccuucgugcccugcagcgggggcuacaaccagggcaucaucgacugccugaucccccaggaguggauccagcacuucuaccaggaguccgccccgagccaguccgacguggcgcugauccgcuacgucaaccccgacaccgggcggacccucuucgaggccaagcugcaccgcagcggcuacaucaccguggcccacuccggggacuacccccuggugguccccgccaacggcuacuuccgcuucgacagcugggugaaccaguucuacucccucgcgccgauggggacgggcaacggccggcgccgggcccaguga

SEQ ID NO: 11513 - RNA, 1617 nt, Artificial Sequence
  derived and/or modified sequence opt1 from VP1__Norovirus_and/or_Norovirus-like__KX171413
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccaccgagacggaccaccgcgacaaguggcacaugcagcugcagaaccucaacgggaccaccuacgaccccaccgacgacgugcccgccccgcugggcacgcccgacuucaaggggguggucuucggcguggccucccagcggaacgucgggaacgacgcccccggcagcacccgcgcccacgaggcggugaucuccaccuacagcccccaguucgugccgaagcugggcagcgucaacuuccgguccaacgacgacgacuuccagcuccagcccaccaaguucacgcccguggggaucaacgacgacggcgaccaccccuuccgccagugggagcugccggacuacagcgggccccugacccucaacaugaaccuggccccgcccguggcccccaacuuccccggcgagcagcuccuguucuuccgguccuucguccccugcagcgggggcuacaaccagggcaucguggacugccugaucccccaggaguggauccagcacuucuaccaggaguccgccccgagccaguccgacguggcccugauccgcuacgucaaccccgacaccgggcggacccucuucgaggcgaagcugcaccgcagcggcuacaucacgguggcccacuccggggacuacccccuggugguccccgccaacggcuacuuccgcuucgacagcugggugaaccaguucuacucccucgccccgauggggaccggcaacggccggcgccgggcgcaguga

SEQ ID NO: 11514 - RNA, 1617 nt, Artificial Sequence
  derived and/or modified sequence opt1 from VP1__Norovirus_and/or_Norovirus-like__KP902565
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacaaccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcguggccagccagcggaacgucgggaacgacgcccccggcuccacgcgcgcgcacgaggccgugaucagcaccuacagcccccaguucgugccgaagcugggcuccgucaacuuccggagcaacgacaacgacuuccagcuccagcccaccaaguucacccccguggggaucaacgacgacggcgaccaccccuuccgccagugggagcugccggacuacuccgggcugcucacgcugaacaugaaccuggccccgcccguggcccccaacuuccccggcgagcagcuccuguucuuccggagcuucguccccugcuccgggggcuacaaccagggcaucguggacugccugaucccccaggaguggauccagcacuucuaccaggagagcgcccccucccagagcgacguggcgcucauccgcuacgucaacccggacaccgggcggacccuguucgaggccaagcugcaccgcuccggcuacaucaccguggcccacagcggggacuacccccucgugguccccgccaacggcuacuuccgcuucgacuccugggugaaccaguucuacagccuggcgcccauggggacgggcaacggccggcgccgggcccaguga

SEQ ID NO: 11515 - RNA, 1617 nt, Artificial Sequence
  derived and/or modified sequence opt1 from VP1__Norovirus_and/or_Norovirus-like__KX171416
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacaaccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcaucgccagccagcggaacguggggaacgacgcccccggcuccacgcgcgcgcacgaggccgucaucagcaccuacagcccccaguucgugccgaagcugggcuccgugaacuuccggagcaacgacaacgacuuccagcuccagcccaccaaguucacccccgucgggaucaacgacgacggcgaccaccccuuccgccagugggagcugccggacuacuccgggcugcucacgcugaacaugaaccuggccccgcccguggcccccaacuuccccggcgagcagcuccuguucuuccggagcuucgugcccugcuccgggggcuacaaccagggcaucgucgacugccugaucccccaggaguggauccagcacuucuaccaggagagcgcccccucccagagcgacguggcgcucauccgcuacgugaacccggacaccgggcggacccuguucgaggccaagcugcaccgcuccggcuacaucaccgucgcccacagcggggacuacccccucguggugcccgccaacggcuacuuccgcuucgacuccugggucaaccaguucuacagccuggcgcccauggggacgggcaacggccggcgccgggcccaguga

SEQ ID NO: 11516 - RNA, 1617 nt, Artificial Sequence
  derived and/or modified sequence opt1 from VP1__Norovirus_and/or_Norovirus-like__KU561250
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcguggccucccagcggaacgucgggaacgacgcccccggcagcacgcgcgcgcacgaggccgccaucuccaccuacagcccccaguucgugccgaagcugggcagcgugaacuuccgguccaacgacaacgacuuccagcuccagcccaccaaguucacccccgucgggaucaacgacgacggcgaccaccccuuccgccagugggagcugccggacuacagcgggcugcucacgcugaacaugaaccuggccccgcccguggcccccaacuuccccggcgagcagcuccuguucuuccgguccuucgugcccugcagcgggggcuacaaccagggcaucgucgacugccugaucccccaggaguggauccagcacuucuaccaggaguccgcgcccagccaguccgacguggcccucauccgcuacgugaacccggacaccgggcggacccuguucgaggccaagcugcaccgcagcggcuacaucaccgucgcccacuccggggacuacccccucguggugcccgcgaacggcuacuuccgcuucgacagcugggucaaccaguucuacucccuggcccccauggggacgggcaacggccggcgccgggcccaguga

SEQ ID NO: 11517 - RNA, 1617 nt, Artificial Sequence
  derived and/or modified sequence opt1 from VP1__Norovirus_and/or_Norovirus-like__KU561251
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccacaacaacgugcuccaggugcagugccagaacgggcggugcacccuggacggcgagcugcaggggacgacccagcuccugccgagcggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcguggccucccagcggaacgucgggaacgacgcccccggcagcacgcgcgcgcacgaggccgugaucuccaccuacagcccccaguucgugccgaagcugggcagcgucaacuuccgguccaacgacaacgacuuccagcuccagcccaccaaguucacccccguggggaucaacgacgacggcgaccaccccuuccgccagugggagcugccggacuacagcgggcugcucacgcugaacaugaaccuggccccgcccguggcccccaacuuccccggcgagcagcuccuguucuuccgguccuucguccccugcagcgggggcuacaaccagggcaucguggacugccugaucccccaggaguggauccagcacuucuaccaggaguccgcccccagccaguccgacguggcgcucauccgcuacgucaacccggacaccgggcggacccuguucgaggccaagcugcaccgcagcggcuacaucaccguggcccacuccggggacuacccccucgugguccccgccaacggcuacuuccgcuucgacagcugggugaaccaguucuacucccuggcgcccauggggacgggcaacggccggcgcaccgcccaguga

SEQ ID NO: 11518 - RNA, 1617 nt, Artificial Sequence
  derived and/or modified sequence opt1 from VP1__Norovirus_and/or_Norovirus-like__AB810014
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuuccgcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugggugaaccaguucuacucccucgcccccaugggcaccgggaacggccgcuga

SEQ ID NO: 11519 - RNA, 1617 nt, Artificial Sequence
  derived and/or modified sequence opt1 from VP1__Norovirus_and/or_Norovirus-like__AB809985
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggccgcuga

SEQ ID NO: 11520 - RNA, 1617 nt, Artificial Sequence
  derived and/or modified sequence opt1 from VP1__Norovirus_and/or_Norovirus-like__AB810003
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugguucaaccaguucuacucccucgcccccaugggcaccgggaacggccgcuga

SEQ ID NO: 11521 - RNA, 1617 nt, Artificial Sequence
  derived and/or modified sequence opt1 from VP1__Norovirus_and/or_Norovirus-like__AB809975
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucuccuaccccagcggcgccagcuacgacccgaccgacgaggugcccgcgccccugggcacccaggacuucuccgggauccuguacggcgugcucacgcaggacaacgucagcgagcgcaccggggaggccaagaacgccaagggcaucuacaucuccaccaccagcgggaaguucacgcccaagaucggcuccaucggccugcacagcaucaccgagaacgugcacccgaaccagcagucccgguucacccccgucgggguggcccagaacgagaacacccccuuccagcagugggugcugccccacuacgccggcgcccucgcgcugaacacgaaccuggccccggccgucgcccccaccuuccccggggagcagcuccuguucuuccgcagccgggugcccugcgugcagggccugcaggggcaggacgcguucaucgacugccuccugccgcaggagugggucaaccacuucuaccaggaggccgcccccucccaggccgacguggcccugauccgcuacgugaaccccgacaccggccggacccucuucgaggcgaagcugcaccgcagcggcuucaucacggucucccacaccggggccuacccccugguggugccgcccaacggccacuuccgguucgacagcugggucaaccaguucuacucccucgcccccauggggaccggcaacgggcgcuga

SEQ ID NO: 11522 - RNA, 1617 nt, Artificial Sequence
  derived and/or modified sequence opt1 from VP1__Norovirus_and/or_Norovirus-like__JX401280
augaagauggccagcuccgacgccaaccccagcgacggcuccagcgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccuguccccggaccucaaccccuaccugagccaccugucccgcauguacaacggcuacgccggcggguucgagguccaggugauccucgccggcaacgccuucaccgccgggaagaucguguucgcggccgugccgcccaacuucccgacggagggccugagccccucccaggugaccauguucccccacaucaucgucgacgugcggcagcuggagcccgugcucaucccgcugcccgacguccgcaacaacuucuaccacuacaaccaggccaacgacagcacccugaagcucaucgccaugcuguacacgccccugcgggccaacaacgcgggggacgacguguucaccguguccugccgcguccucacccggcccagcccggacuucgacuucaucuuccuggugccgcccaccguggagucccgcaccaagcccuucacgguccccgugcugaccguggaggagaugaccaacagccgguuccccaucccccucgagcgccuguucaccggccccuccacggccuucgucgugcagccgcagaacggccggugcaccaccgacgggguccugcucggcaccacgcagcugagcgccgugaacaucugcaacuuccgcggggaggugaaccacaucgccggcacccacgacuacaccaugcggcugaccucccagaacuggaacaacuacgaccccacggaggagauccccgccccgcucggcacccccgacuucgucgggcgcauccagggcgugcugacccagaccacgcggagcgacgggagcacccgcucccacaaggcgaccgugagcaccggcuccguccacuucacgcccaagcuggggagcgugcaguucaccaccgacaccacgaacgaccucaacgccggccagaacaccaaguucacccccgugggcgucgagcagaccuccggggaccaccagagcgagccgcagcaguggacgcugcccaacuacuccggcacccccaaccacaacgugcaccuggcccccgccguggccccgaccuuccccggggagcagcuccuguucuuccggagcacccugcccggcugcgggggcuaccccaacaugaaccucgacugccugcugccgcaggaguggguccuccacuucuaccaggaggcggcccccgcccaguccgacguggcccugcugcgcuucgugaaccccgacaccggccggguccucuucgagugcaagcugcaccgcagcggguucaucacgguggcgcacuccggcagccacgaccuggugaucccgcccaacggguacuuccgguucgacuccugggucaaccaguucuacacccucgcccccaugggcaacgggagcggccgccgccggguguga

SEQ ID NO: 11523 - RNA, 1617 nt, Artificial Sequence
  derived and/or modified sequence opt1 from VP1__Norovirus_and/or_Norovirus-like__KC962462
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggagucccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggggacgacguguucaccguguccugccgcguccugacccggccgagccccgacuucgacuucaucuuccucgugccgcccaccguggagucccgcaccaagcccuucagcguccccauccugacgguggaggagaugaccaacucccgguuccccaucccccuggagaagcuguucaccggcccgagcuccgccuucgugguccagccccagaacggccgcugcaccaucgacggggugcugcugggcacgacccagcucagccccgucaacaucugcaccuuccgcggggacgugacccacaucgccggcacgcacaacuacaccaugaaccuggccacccagaacuggaacuccuacgacccgaccgaggagauccccgcgccccugggcacgcccgacuucguggggaagauccagggcguccucacccagaccaccaagacggacgggagcacccggggccacaaggccaccgugugcaucgggagcgccgacuucgccccgaagcugggccgggugcaguucgagaccgacacgaacaacgaccuggagaccaaccagaacaccaaguucacccccgucggcgugauccagaacggggagacggcccaccgcaacgagccccagcagugggugcuccccuccuacagcggccggaacaccccgaacguccaccuggcgcccgccguggcccccaccuuccccggggagcagcuccucuucuuccgcuccaccaugccgggcugcagcggguaccccaacauggaccuggacugccugcucccccaggagugggugcaguacuucuaccaggaggccgcgcccgcccaguccgacgucgcccugcugcgguucgugaacccggacacgggccgcguccucuucgagugcaagcugcacaagagcggcuacgugaccguggcccacaccgggucccacgaccuggugaucccgcccaacggcuacuuccgguucgacagcugggucaaccaguucuacacccucgcccccauggggaacggcaccgggcgccggcgcuga

SEQ ID NO: 11524 - RNA, 1617 nt, Artificial Sequence
  derived and/or modified sequence opt1 from VP1__Norovirus_and/or_Norovirus-like__KX353974
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgccgacuucacccccaagcugggguccgugcaguucggcacggacaccgagaacgacuucgagauccaccagaacacccgcuucaccccggucggggugauccaggacggcagcacgacccaccggaacgagccccagcagugggugcuccccuccuacagcgggcgcuccguccacaacgugcaccuggcccccgccguggcgccgaacuuccccggcgagcagcuccucuucuuccggagcaccaugcccggcugcuccggguaccccaacauggaccuggacugccugcucccgcaggaguggguccagcacuucuaccaggaggccgcccccgcccagagcgacguggcgcugcugcgcuucgugaaccccgacaccggccggguccucuucgagugcaagcugcacaaguccggguacgugacgguggcccacaccggccagcacgaccuggucaucccgcccaacggguacuuccgcuucgacagcugggugaaccaguucuacacccucgcccccaugggcaacggcaccgggcggcgccgcuga

SEQ ID NO: 11525 - RNA, 1617 nt, Artificial Sequence
  derived and/or modified sequence opt1 from VP1__Norovirus_and/or_Norovirus-like__KF060122
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccgucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccacaacuacaccaugaaccuggccucccagaacuggaacagcuacgacccgaccgaggagauccccgcgccccuggggacgcccgacuucgugggcaagauccagggggugcucacccagaccacccgcgccaacggcagcacgcgggggcacaaggccaccgucuacaccggcuccgccgacuucgccccgaagcugggccgcgugcaguucgccaccgacacgaacaacgacuucgacgcgaaccagaacaccaaguucacccccgugggggucauccaggacggcgacaccgcccaccggaacgagccccagcagugggugcugcccagcuacuccgggcgcaacagccacaacgugcaccucgccccggccgucgcgcccacguuccccggcgagcagcugcuguucuuccgguccaccaugcccgggugcagcggcuacccgaacauggaccucgacugccugcugccccaggagugggugcaguacuucuaccaggaggccgcccccgcccaguccgacguggcccuccugcgcuucgucaaccccgacaccggccgggugcuguucgagugcaagcuccacaagagcggguacgugaccgucgcgcacacgggccagcacgaccuggugaucccgcccaacggguacuuccgcuucgacuccugggugaaccaguucuacacccuggcccccaugggcaacgggaccggccggcgccgcuga

SEQ ID NO: 11526 - RNA, 1617 nt, Artificial Sequence
  derived and/or modified sequence opt1 from VP1__Norovirus_and/or_Norovirus-like__KR904234
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacuccgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcagcuuccggggcgacgugacgcacaucgccggcagccgcaacuacaccaugaaccuggccucccagaacuggaacagcuacgacccgaccgaggagauccccgcgccccuggggacccccgacuucgugggcaagauccaggggguccucacgcagaccacccggaccgacggcuccacgcgcgggcaccgggccaccguguacaccggcagcgccgacuucuccccgaagcugggccgcgugcaguucgccaccgacacggacaacgacuucgucgccaaccagaacaccaaguucacccccgugggggugauccaggacggcgacaccgcccaccggaacgagccccagcaguggguccugcccagcuacuccgggcgcaacauccacaacgugcaccucgcgccggccguggcccccacguuccccggcgagcagcugcuguucuuccggagcaccaugcccgggugcuccggcuacccgaacauggaccucgacugccugcugccccaggaguggguccagcacuucuaccaggaggccgcgcccgcccagagcgacguggcccuccugcgcuucgugaaccccgacaccggccggguccuguucgagugcaagcuccacaaguccggguacgugaccguggcccacacgggccagcacgaccuggucaucccgcccaacggguacuuccgcuucgacagcugggugaaccaguucuacacccuggcccccaugggcaacgggaccggccgccggcgcuga

SEQ ID NO: 11527 - RNA, 1617 nt, Artificial Sequence
  derived and/or modified sequence opt1 from VP1__Norovirus_and/or_Norovirus-like__KR131769
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccaucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcacggggcgccggcgcuga

SEQ ID NO: 11528 - RNA, 1617 nt, Artificial Sequence
  derived and/or modified sequence opt1 from VP1__Norovirus_and/or_Norovirus-like__KR131764
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccagcucccggaacuacaccaugaaccuggccagccagaacuggaacaacuacgaccccacggaggagaucccggcgccccugggcacccccgacuucguggggaagauccagggcaugcucacccagaccacgaaguccgacgggagcacccgcggccacaaggccaccguccugaccgggagcgccgacuucgcccccaagcugggccgggugcaguucgccacggacaccgacaacgacuucgaguccggccagaacaccaaguucaccccggugggggucauccaggacggcagcacgacccaccgcaacgagccccagcagugggugcuccccaacuacuccgggcggaccggccacaacgugcaccuggcgcccgccgucgccccgaccuaccccggggagcagcuccucuucuuccgcagcacgaugcccggcugcuccggcuaccccaacauggaccuggacugccugcucccgcaggagugggugcagcacuucuaccaggaggccgcgcccgcccagagcgacguggcccugcugcgguucgucaaccccgacaccgggcgcgugcuguucgagugcaagcugcacaaguccggcuacgugaccgucgcccacaccgggcagcacgaccuggugaucccgcccaacggcuacuuccgguucgacagcugggugaaccaguucuacacccucgcccccauggggaacggcacgggccgccgccgguga

SEQ ID NO: 11529 - RNA, 1617 nt, Artificial Sequence
  derived and/or modified sequence opt1 from VP1__Norovirus_and/or_Norovirus-like__GU390901
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggccacccagaacuggaacagcuacgacccgaccgaggagauccccgcgccccuggggacccccgacuucgugggcaagauccaggggguccucacgcagaccacccgggccgacggcuccacccgcgggcacaaggccacgguguacaccggcagcgccgacuucagcccgaagcugggccgggugcaguucgccaccgacaccgacaacgacuucgacgccaaccagaacacgaaguucacccccgucggggugauccaggacggcgacaccgcccaccgcaacgagccccagcagugggugcugcccuccuacagcgggcggaacucccacaacguccaccucgcgccggccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 11530 - RNA, 1617 nt, Artificial Sequence
  derived and/or modified sequence opt1 from VP1__Norovirus_and/or_Norovirus-like__EU078408
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgcggcccuucaccguccccauccugaccguggaggagaugaccaacucccgcuuccccaucccccuggagaagcuguucacgggcccgagcggggccuucgugguccagccccagaacggccggugcaccaccgacggggugcugcugggcaccacgcagcucucccccgucaacaucugcaccuuccgcggcgacgugacccacaucgccgggacccacgacuacacgaugaaccuggccagccagaacuggaacaacuacgacccgaccgaggagauccccgcgccccugggcacccccgacuucguggggaagauccagggcguccucucccagaccacgcgcggggacggcagcacccggggccacaaggccaccguguccaccgggagcgugcacuucacgccgaagcugggcagcguccaguucaccaccgacaccaacaacgaccuggagacggggcagaacaccaaguucacccccgugggcgugguccaggacgggaacuccacccaccagaacgagccccagcagugggugcuccccaacuacagcggccggacgggccacaacgugcaccuggccccggccgucgcccccaccuuccccggggagcagcuccucuucuuccgcuccaccaugcccggcugcagcggguacccgaacaugaaccuggacugccugcucccccaggagugggugcagcacuucuaccaggaggccgcgcccgcccaguccgacguggcccugcugcgguucgucaaccccgacaccggccgcguccucuucgagugcaagcugcacaagagcggguacgugaccguggcccacacgggccagcacgaccuggugaucccgcccaacggcuacuuccgguucgacuccugggugaaccaguucuacacccucgcgcccauggggaacggcgccgggcgccggcgcuga

SEQ ID NO: 11531 - RNA, 1617 nt, Artificial Sequence
  derived and/or modified sequence opt1 from VP1__Norovirus_and/or_Norovirus-like__AB933676
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucuccaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccgcccaccgcaacgagccccagcagugggugcuccccagcuacuccggccggaacguccagaacgugcaccuggccccggcgguggcccccaccuuccccggggagcagcuccucuucuuccgcagcaccaugcccggcugcuccggcuacccgaacauggaccuggacugccugcucccccaggaguggguccagcacuucuaccaggaggccgcccccgcgcagagcgacguggcccugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcaccggccgccggcgcuga

SEQ ID NO: 11532 - RNA, 1617 nt, Artificial Sequence
  derived and/or modified sequence opt1 from VP1__Norovirus_and/or_Norovirus-like__KX354082
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgacgacguguucaccgucuccugccgcgugcugacccggcccagcccggacuucgacuucaucuuccucgugccgcccaccgucgagucccgcaccaagcccuucacggugcccauccugaccguggaggagaugaccaacagccgguuccccaucccccuggagaagcuguucaccggccccuccagcgccuucgucgugcagccgcagaacgggcgcugcacgaccgacggcguccugcuggggaccacccagcucucccccgugaacaucugcacguuccggggcgacgugacccacaucgccggcagccgcaacuacaccaugaaccuggccucccugaacuggaacaacuacgaccccaccgaggagaucccggcgccccucgggacgcccgacuucgucggcaagauccagggggugcugacccagaccaccaagcgggacggcagcacgcgcgggcacaaggccaccguguacaccggcagcgccgacuucacccccaagcugggcuccguccaguucgggacggacaccgagaacgacuucgagacccaccagaacacccgguucacgccggugggcgugauccaggacgggagcaccacccaccgcaacgagccccagcaguggguccuccccuccuacagcggccggaacgugcacaacgugcaccuggcccccgccgucgcgccgaacuuccccggggagcagcuccucuucuuccgcuccaccaugcccggcugcagcggcuaccccaacauggaccuggacugccugcucccgcaggagugggugcagcacuucuaccaggaggccgcccccgcccaguccgacguggcgcugcugcgguucgucaaccccgacacggggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcaccggccgccgccgguga

SEQ ID NO: 11533 - RNA, 1617 nt, Artificial Sequence
  derived and/or modified sequence opt1 from VP1__Norovirus_and/or_Norovirus-like__KJ407076
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucuccaccgggagcgugcacuucacccccaagcugggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccggguguga

SEQ ID NO: 11534 - RNA, 1617 nt, Artificial Sequence
  derived and/or modified sequence opt1 from VP1__Norovirus_and/or_Norovirus-like__JX459636
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggccggaacguccagaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11535 - RNA, 1617 nt, Artificial Sequence
  derived and/or modified sequence opt1 from VP1__Norovirus_and/or_Norovirus-like__JX445161
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggccacccagaacuggaacagcuacgacccgaccgaggagauccccgcgccccuggggacccccgacuucgugggcaagauccaggggguccucacgcagaccacccgggccgacggcuccacccgcgggcacaaggccacgguguacaccggcagcgccgacuucgccccgaagcugggccgggugcaguucgccaccgacaccgacaacgacuucgacgccaaccagaacacgaaguucacccccgucggggugauccaggacggcgacaccgcgcaccgcaacgagccccagcagugggugcugcccagcuacuccgggcggaacagccacaacguccaccucgccccggccguggcccccaccuuccccggcgagcagcugcuguucuuccgcuccacgaugcccgggugcagcggcuacccgaacauggaccucgacugccugcugccccaggagugggugcaguacuucuaccaggaggcggcccccgcccaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggacgggccgccgccgguga

SEQ ID NO: 11536 - RNA, 1617 nt, Artificial Sequence
  derived and/or modified sequence opt1 from VP1__Norovirus_and/or_Norovirus-like__EU876888
augaagauggccagcuccgacgccagccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccugagccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcggcgacgggagcacccggggccacaaggccaccgucuacaccggcagcgccgacuucgcccccaagcuggggcgcgugcaguucgccacggacaccgacaacgacuucgaguccaaccagaacaccaaguucaccccggugggcgucauccaggacgggaacacgacccaccggaacgagccccagcagugggugcugcccggcuacagcgggcgcgacggccacaacgugcaccucgcgcccgccgucgccccgaccuaccccggcgagcagcugcuguucuuccgguccaccaugcccgggugcagcggcuaccccaacauggaccucgacugccugcugccgcaggagugggugcagcacuucuaccaggaggccgcgcccgcccaguccgagguggcccuccugcgcuucgucaaccccgacacggggcgggugcuguucgagugcaagcuccacaagagcggcuacgugaccgucgcccacaccgggcagcacgaccuggugaucccgcccaacggcuacuuccgcuucgacuccugggugaaccaguucuacacccuggcccccaugggcaacggggcgggccgccggcgcuga

SEQ ID NO: 11537 - RNA, 1617 nt, Artificial Sequence
  derived and/or modified sequence opt1 from VP1__Norovirus_and/or_Norovirus-like__EU839584
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgaccaagcgcgacggcagcacccgggggcacaaggccaccguguccacgggcagcgugcacuucaccccgaagcugggcagcguccaguucuccaccgacaccagcaacgacuucgagaucgggcagaacacgcgcuucacccccgugggcgugguccaggacggguccaccacccaccagaacgagccccagcagugggugcugcccaacuacagcggccgggacgggcacaacgugcaccucgccccggccgucgcccccacguuccccggcgagcagcugcuguucuuccgcuccaccaugcccggcugcagcggguacccgaacaugaaccucgacugccugcugccccaggagugggugcagcacuucuaccaggaguccgcccccgcgcagagcgacguggcccuccugcgguucgucaaccccgacaccggccgcgcccuguucgagugcaagcuccacaaguccggguacgugaccguggcccacaccggccagcacgaccuggucaucccgcccaacggguacuuccgguucgacagcugggugaaccaguucuacacgcuggcgcccaugggcaacggcgccgggcgccggcgcuga

SEQ ID NO: 11538 - RNA, 1617 nt, Artificial Sequence
  derived and/or modified sequence opt1 from VP1__Norovirus_and/or_Norovirus-like__KX354090
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgccgacuucacccccaagcugggguccgugcaguucggcacggacaccgagaacgacuucgagacccaccagaacacccgcuucacgccggucggggugauccaggacggcagcaccacccaccggaacgagccccagcagugggugcuccccuccuacagcgggcgcaacguccacaacgugcaccuggcccccgccguggcgccgaacuuccccggcgagcagcuccucuucuuccgguccaccaugcccggcugcagcggguaccccaacauggaccuggacugccugcucccgcaggaguggguccagcacuucuaccaggaggccgcccccgcccaguccgacguggcgcugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgcuga

SEQ ID NO: 11539 - RNA, 1617 nt, Artificial Sequence
  derived and/or modified sequence opt1 from VP1__Norovirus_and/or_Norovirus-like__KF060124
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccgucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccacaacuacaccaugaaccuggccucccagaacuggaacagcuacgacccgaccgaggagauccccgcgccccuggggacgcccgacuucgugggcaagauccagggggugcucacccagaccacccgcgccgacggcagcacgcgggggcacaaggccaccgucuacaccggcuccgccgacuucgccccgaagcugggccgcgugcaguucgccaccgacacgaacaacgacuucgacgcgaaccagaacaccaaguucacccccgugggggucauccaggacggcgacaccgcccaccggaacgagccccagcagugggugcugcccagcuacuccgggcgcaacagccacaacgugcaccucgccccggccgucgcgcccacguuccccggcgagcagcugcuguucuuccgguccaccaugcccgggugcagcggcuacccgaacauggaccucgacugccugcugccccaggagugggugcaguacuucuaccaggaggccgcccccgcccaguccgacguggcccuccugcgcuucgucaaccccgacaccggccgggugcuguucgagugcaagcuccacaagagcggguacgugaccgucgcgcacacgggccagcacgaccuggugaucccgcccaacggguacuuccgcuucgacuccugggugaaccaguucuacacccuggcccccaugggcaacgggaccggccggcgccgcuga

SEQ ID NO: 11540 - RNA, 1617 nt, Artificial Sequence
  derived and/or modified sequence opt1 from VP1__Norovirus_and/or_Norovirus-like__JX439826
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacgugacgcacaucaccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgcgaaccagaacaccaaguucacccccgucggggugauccaggacggcgacacggcccaccgcaacgagccccagcagugggugcugcccuccuacagcgggcggaacucccacaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcccuccugcgguucgugaaccccgacaccggccgcgugcuguucgagugcaagcuccacaaguccggguacgucacgguggcgcacaccggccagcacgaccuggugaucccgcccaacggguacuuccgguucgacagcugggucaaccaguucuacacccuggcccccaugggcaacgggaccggccgccgccgguga

SEQ ID NO: 11541 - RNA, 1617 nt, Artificial Sequence
  derived and/or modified sequence opt1 from VP1__Norovirus_and/or_Norovirus-like__JX439815
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgguga

SEQ ID NO: 11542 - RNA, 1617 nt, Artificial Sequence
  derived and/or modified sequence opt1 from VP1__Norovirus_and/or_Norovirus-like__KC576912
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagaugauccucgccgggaacgccuucaccgccggcaagaucaucuucgccgccgucccgcccaacuucccgacggaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucacggugcccguccugaccguggaggagaugaccaacucccgguuccccaucccccuggagaagcuguucaccggcccgagcuccgccuucgugguccagccccagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgacccgaccgaggagauccccgcgccccucgggacgcccgacuucgugggcaagauccaggggguccugacccagaccaccaagggcgacggguccacgcggggccacaaggccaccguguacaccggcagcgccgacuucaccccgaagcuggggagcgugcaguucggcacggacaccgacaacgacuucgagacccaccagaacacccgcuucacgcccgucggggugauccaggacggcgccaccacccaccggaacgagccccagcagugggugcuccccuccuacagcgggcgcaacguccacaacgugcaccuggccccggcgguggcccccaacuuccccggcgagcagcuccucuucuuccgguccaccaugcccggcugcagcggguacccgaacauggaccuggacugccugcucccccaggaguggguccagcacuucuaccaggaggccgcccccgcgcaguccgacguggcccugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgcuga

SEQ ID NO: 11543 - RNA, 1617 nt, Artificial Sequence
  derived and/or modified sequence opt1 from VP1__Norovirus_and/or_Norovirus-like__GQ845368
augaagauggccagcuccgacgccagccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccugagccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucaccggcagccggaacuacacgaugaaccuggccucccagaacuggaacaacuacgaccccaccgaggagaucccggcgccccuggggacccccgacuucgugggcaagauccaggggaugcucacccagacgacccgcggcgacgggagcacccggggccacaaggccaccgucuacacgggcagcgccgacuucgcccccaagcuggggcgcgugcaguucgccaccgacaccgacaacgacuucgaguccaaccagaacaccaaguucacgccggugggcgucauccaggacgggaacaccacccaccagaacgagccccagcagugggugcugcccggcuacagcgggcgggacggccacaacgugcaccucgcccccgcggucgccccgaccuaccccggcgagcagcugcuguucuuccgcuccacgaugcccgggugcagcggcuaccccaacaugaaccucgacugccugcugccgcaggagugggugcagcacuucuaccaggaggccgcccccgcgcaguccgagguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccaugggcaacggggccggccgccgccgguga

SEQ ID NO: 11544 - RNA, 1617 nt, Artificial Sequence
  derived and/or modified sequence opt1 from VP1__Norovirus_and/or_Norovirus-like__AB541249
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcgacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacguccagaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11545 - RNA, 1617 nt, Artificial Sequence
  derived and/or modified sequence opt1 from VP1__Norovirus_and/or_Norovirus-like__EU078412
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgacgacguguucaccgugagcugccgcguccucacccggccgucccccgacuucgacuucaucuuccuggugccgcccaccguggagagccgcacgaagcccuucaccguccccauccugaccguggaggagaugaccaacucccgguuccccaucccccucgagaagcuguucacgggcccgagcggggccuucgugguccagccccagaacggccgcugcaccaccgacggggugcugcucggcaccacgcagcugucccccgucaacaucugcaccuuccggggcgacgugacccacaucgccgggacccacgacuacacgaugaaccuggccagccagaacuggaacaacuacgacccgaccgaggagauccccgcgccccucggcacccccgacuucguggggaagauccagggcguccugacccagacgacccgcggggacggcuccacccggggccacaaggccaccgugagcacgggguccgugcacuucaccccgaagcugggcagcguccaguucaccaccgacacgaacaacgaccucgagaccgggcagaacacccgcuucacccccgugggcgugguccaggacgggaacagcacgcaccagaacgagccccagcagugggugcugcccaacuacuccggccgggccggccacaacgugcaccuggccccggccgucgcccccaccuuccccggggagcagcuccuguucuuccgcagcaccaugcccggcugcuccggguacccgaacaugaaccuggacugccuccugccccaggagugggugcagcacuucuaccaggaggcggcccccgcccagagcgacguggcccugcuccgguucgucaaccccgacaccggccgcgugcuguucgagugcaagcugcacaaguccggguacgugaccgucgcgcacacgggccagcacgaccucgugaucccgcccaacggcuacuuccgguucgacagcugggugaaccaguucuacacccuggcccccauggggaacggcgccgggcgccggcgcuga

SEQ ID NO: 11546 - RNA, 1617 nt, Artificial Sequence
  derived and/or modified sequence opt1 from VP1__Norovirus_and/or_Norovirus-like__AB445395
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccuccuacagcgggcggaacaaccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgguga

SEQ ID NO: 11547 - RNA, 1617 nt, Artificial Sequence
  derived and/or modified sequence opt1 from VP1__Norovirus_and/or_Norovirus-like__AB933655
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucggcacggacaccgagaacgacuucgagacccaccagaacaccaaguucacgccggucggggugauccaggacggcuccaccacccaccgcaacgagccccagcagugggugcuccccagcuacuccgggcggaacguccacaacgugcaccuggcccccgccguggcgccgaacuuccccggcgagcagcuccucuucuuccgcagcaccaugcccggcugcuccggguaccccaacauggaccuggacugccugcucccgcaggaguggguccagcacuucuaccaggaggccgcccccgcccagagcgacguggcgcugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11548 - RNA, 1617 nt, Artificial Sequence
  derived and/or modified sequence opt1 from VP1__Norovirus_and/or_Norovirus-like__KM245072
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcagcacccgcgggcacaaggccaccguguacacgggcuccgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgguga

SEQ ID NO: 11549 - RNA, 1617 nt, Artificial Sequence
  derived and/or modified sequence opt1 from VP1__Norovirus_and/or_Norovirus-like__AB541282
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacguccagaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11550 - RNA, 1617 nt, Artificial Sequence
  derived and/or modified sequence opt1 from VP1__Norovirus_and/or_Norovirus-like__AB541202
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccacgcagaacuggaacuccuacgacccgaccgaggagauccccgcgccccuggggacccccgacuucgucggcaagauccagggggugcucacccagacgacccgggccgacggcagcacccgcgggcacaaggccaccguguacacgggcagcgccgacuucgccccgaagcugggccggguccaguucgccaccgacaccgacaacgacuucgacgccaaccagaacaccaaguucacgcccgugggggugauccaggacggcgacaccgcgcaccgcaacgagccccagcaguggguccugcccuccuacagcgggcggaacaaccacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggcggcccccgcccaguccgacguggcccuccugcgguucgugaaccccgacacgggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacgggaccggccgccgccgguga

SEQ ID NO: 11551 - RNA, 1617 nt, Artificial Sequence
  derived and/or modified sequence opt1 from VP1__Norovirus_and/or_Norovirus-like__FJ514242
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggaggugcccgcgccccucgggacgcccgacuucgucggcaagauccagggggugcugacccagaccaccaagggcgacgggagcacgcggggccacaaggccaccguguacaccggcuccgccccguucacccccaagcuggggagcguccaguucagcacggacaccgagaacgacuucgagacccaccagaacaccaaguucacgcccgugggcgugauccaggacggguccaccacccaccgcaacgagccccagcaguggguccucccgagcuacuccggccggaacgugcagaacgugcaccuggcccccgccgucgcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacguggcgcugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcuga

SEQ ID NO: 11552 - RNA, 1617 nt, Artificial Sequence
  derived and/or modified sequence opt1 from VP1__Norovirus_and/or_Norovirus-like__KX353976
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucaucguggacgugcggcagcuggagcccguccucaucccgcugcccgacauccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucggcacggacaccgacaacgacuucgagacccaccagaacaccaaguucacgccggucggggugauccaggacggcuccaccacccaccgcaacgagccccagcagugggugcuccccagcuacuccgggcggaacguccagaacgugcaccuggcccccgccguggcgccgaacuuccccggcgagcagcuccucuucuuccgcagcaccaugcccggcugcuccggguaccccaacauggaccuggacugccugcucccgcaggaguggguccagcacuucuaccaggaggccgcccccgcccagagcgacguggcgcugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11553 - RNA, 1617 nt, Artificial Sequence
  derived and/or modified sequence opt1 from VP1__Norovirus_and/or_Norovirus-like__KX353952
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacgugugcacguuccggggcgacgugacccacaucgccggcagccgcaacuacaccaugaaccuggccucccugaacuggaacaacuacgaccccaccgaggagaucccggcgccccucgggacgcccgacuucgucggcaagauccagggggugcugacccagaccaccaagggcgacgggagcacgcggggccacaaggccaccguguacaccggcagcgccgacuucacccccaagcugggguccguccaguucggcacggacaccgagaacgacuucgagacccaccagaacacccgcuucacgccggugggggugauccaggacggcagcaccacccaccggaacgagccccagcaguggguccuccccuccuacagcgggcgcaacgugcacaacgugcaccuggcccccgccgucgcgccgaacuuccccggcgagcagcuccucuucuuccgguccaccaugcccggcugcagcggguaccccaacauggaccuggacugccugcucccgcaggagugggugcagcacuucuaccaggaggccgcccccgcccaguccgacguggcgcugcugcgcuucgucaaccccgacacgggccggguccucuucgagugcaagcugcacaagagcggguacgugaccguggcccacaccggccagcacgaccuggugaucccgcccaacggguacuuccgcuucgacuccugggugaaccaguucuacacccucgcccccaugggcaacggcaccgggcggcgccgcuga

SEQ ID NO: 11554 - RNA, 1617 nt, Artificial Sequence
  derived and/or modified sequence opt1 from VP1__Norovirus_and/or_Norovirus-like__KR131771
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcacggggcgccggcgcuga

SEQ ID NO: 11555 - RNA, 1617 nt, Artificial Sequence
  derived and/or modified sequence opt1 from VP1__Norovirus_and/or_Norovirus-like__AB933729
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaucguguacaccggcagcgccgacuucgccccgaagcugggccgggugcaguucgccacggacaccgacaacgacuucggggccaaccagaacaccaaguucacccccgucggcgugauccaggacggggacacggcgcaccgcaacgagccccagcagugggugcugcccuccuacagcggccggaacucccacaacguccaccucgccccggccguggcccccaccuuccccggggagcagcugcuguucuuccgcagcaccaugcccggcugcuccggcuacccgaacauggaccucgacugccugcugccccaggagugggugcaguacuucuaccaggaggcggcccccgcccagagcgacgucgcccuccugcgguucgugaaccccgacaccgggcgcgugcuguucgagugcaagcuccacaaguccggcuacgucacgguggcccacaccgggcagcacgaccuggugaucccgcccaacggcuacuuccgguucgacagcugggucaaccaguucuacacccuggcgcccauggggaacggcaccggccgccgccgguga

SEQ ID NO: 11556 - RNA, 1617 nt, Artificial Sequence
  derived and/or modified sequence opt1 from VP1__Norovirus_and/or_Norovirus-like__AB933646
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgagguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11557 - RNA, 1617 nt, Artificial Sequence
  derived and/or modified sequence opt1 from VP1__Norovirus_and/or_Norovirus-like__JX155742
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucggcacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggcgagcagcuccucuucuuccgcagcacgaugccggggugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 11558 - RNA, 1617 nt, Artificial Sequence
  derived and/or modified sequence opt1 from VP1__Norovirus_and/or_Norovirus-like__JN400614
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccagcuucacccccaagcugggguccgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggcgccgaccuuccccggggagcagcuccucuucuuccgcagcacgaugcccggcugcuccggcuaccccaacauggaccuggacugccugcucccgcaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11559 - RNA, 1617 nt, Artificial Sequence
  derived and/or modified sequence opt1 from VP1__Norovirus_and/or_Norovirus-like__JN400601
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaaggggaacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacaucaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11560 - RNA, 1617 nt, Artificial Sequence
  derived and/or modified sequence opt1 from VP1__Norovirus_and/or_Norovirus-like__JQ613538
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucguguucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccacaacuacaccaugaaccuggccucccagaacuggaacagcuacgacccgaccgaggagauccccgcgccccuggggacgcccgacuucgugggcaagauccaggggguccucacccagaccacccgcacggacggcagcacccgggggcacaaggccaccguguacaccggcuccgccgaguucagcccgaagcugggccgcauccaguucgccacggacaccaacaacgacuucgacgccaaccagaacaccaaguucacccccgugggggucauccaggacggcgggacgacccaccggaacgagccccagcagugggugcugcccuccuacagcggccgcaacacccacaacgugcaccucgccccggcggucgcccccaccuuccccggggagcagcugcuguucuuccgguccacgcuccccggcugcagcggcuacccgaacauggaccuggacugccugcucccccaggagugggugcaguacuucuaccaggaggccgcccccgcgcaguccgacguggcccugcugcgcuucgucaaccccgacaccgggcggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcacgggccggcgccgcuga

SEQ ID NO: 11561 - RNA, 1617 nt, Artificial Sequence
  derived and/or modified sequence opt1 from VP1__Norovirus_and/or_Norovirus-like__HM802543
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggggacaccacgcaccagaacgagccccagcagugggugcugcccgacuacuccggccgcgacagccacaacgugcaccucgccccggccgucgcccccaccuuccccggggagcagcugcuguucuuccgguccaccaugcccggcugcagcggcuacccgaacaugaaccucgacugccugcugccccaggagugggugcagcacuucuaccaggaguccgcccccgcgcagagcgacguggcccuccugcgcuucgucaaccccgacaccgggcgggugcuguucgagugcaagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcuga

SEQ ID NO: 11562 - RNA, 1617 nt, Artificial Sequence
  derived and/or modified sequence opt1 from VP1__Norovirus_and/or_Norovirus-like__AB541337
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcgacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11563 - RNA, 1617 nt, Artificial Sequence
  derived and/or modified sequence opt1 from VP1__Norovirus_and/or_Norovirus-like__AB541252
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucaucgugcagccgcagaacgggcgcugcacgaccgacggcguccugcuggggaccacccagcucagccccgugaacaucugcacguuccggggcgacgucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgccgacuucacccccaagcuggggagcgugcaguucggcacggacaccgagaacgacuucgagacccaccagaacaccaaguucacgccggugggggucauccaggacggcuccaccacccaccgcaacgagccccagcagugggugcuccccagcuacuccgggcggaacgugcacaacguccaccuggcccccgccguggcgccgaacuuccccggcgagcagcuccucuucuuccgcagcaccaugcccggcugcuccggguaccccaacauggaccuggacugccugcucccgcaggagugggugcagcacuucuaccaggaggccgcccccgcccagagcgacgucgcgcugcugcgguucgugaaccccgacacgggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcaccgggcgccggcgcuga

SEQ ID NO: 11564 - RNA, 1617 nt, Artificial Sequence
  derived and/or modified sequence opt1 from VP1__Norovirus_and/or_Norovirus-like__GU270580
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucagcccgaagcugggccggauccaguucgccaccgacaccgacaacgacuucgacgccaaccagaacaccaaguucacgcccgugggggucauccaggacggcaacaccgcgcaccgcaacgagccccagcagugggugcugcccuccuacagcgggcggaacucccacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacacgggccgcgugcuguucgagugcaagcuccacaagaccggguacgugaccgucgcccacaccggccagcacgaccuggugaucccgcccaacggguacuuccgguucgacuccugggugaaccaguucuacacccuggcgcccaugggcaacgggacgggccgccgccgguga

SEQ ID NO: 11565 - RNA, 1617 nt, Artificial Sequence
  derived and/or modified sequence opt1 from VP1__Norovirus_and/or_Norovirus-like__EU876882
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcgcggggcgccggcgcuga

SEQ ID NO: 11566 - RNA, 1617 nt, Artificial Sequence
  derived and/or modified sequence opt1 from VP1__Norovirus_and/or_Norovirus-like__AB933649
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggggcaacguccagaacgugcaccuggccccggcgguggcccccaccuuccccggcgagcagcuccucuucuuccggagcacgaugcccgggugcuccggcuacccgaacauggaccuggacugccugcucccccaggaguggguccagcacuucuaccaggaggccgcccccgcgcagagcgacguggcccugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccaugggcaacgggacgggccggcgccgguga

SEQ ID NO: 11567 - RNA, 1617 nt, Artificial Sequence
  derived and/or modified sequence opt1 from VP1__Norovirus_and/or_Norovirus-like__JX439816
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucuccccgaagcugggccgggugcaguucgccaccgacaccgacaacgacuucgacgccaaccagaacaccaaguucacgcccgucggggugauccaggacggcgacaccgcccaccgcaacgagccccagcagugggugcugcccagcuacuccgggcggaacagccacaacguccaccucgcgccggccguggcccccaccuuccccggcgagcagcugcuguucuuccgcuccaccaugcccgggugcagcggcuacccgaacauggaccucgacugccugcugccccaggagugggugcaguacuucuaccaggaggccgcgcccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 11568 - RNA, 1617 nt, Artificial Sequence
  derived and/or modified sequence opt1 from VP1__Norovirus_and/or_Norovirus-like__JX155739
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11569 - RNA, 1617 nt, Artificial Sequence
  derived and/or modified sequence opt1 from VP1__Norovirus_and/or_Norovirus-like__HQ456338
augaagauggccagcaacgacgccucccccagcgacggcuccgcggccaaccuggugccggaggucaacaacgaggugauggcccucgagcccguggucggggccgccaucgcggcccccguggccggccagaagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11570 - RNA, 1617 nt, Artificial Sequence
  derived and/or modified sequence opt1 from VP1__Norovirus_and/or_Norovirus-like__AB541359
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccgugcugaccguggaggagaugaccaacucccgguuccccaucccccuggagaagcuguucacgggccccagcggggccuucgucgugcagccgcagaacggccgcugcaccaccgacgggguccugcugggcaccacgcagcucucccccgugaacaucugcaccuuccggggcgacgugacccacaucgccgggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgagacccaccagaacacgaaguucacccccgugggggugauccaggacggcuccaccacccaccgcaacgagccccagcaguggguccuccccagcuacuccgggcggaacgugcacaacgugcaccuggccccggccgucgcgcccacguuccccggcgagcagcuccucuucuuccgcagcaccaugcccggcugcuccggguacccgaacauggaccuggacugccugcucccccaggagugggugcagcacuucuaccaggaggccgcccccgcccagagcgagguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacgcucgcccccaugggcaacggcaccgggcgccggcgcuga

SEQ ID NO: 11571 - RNA, 1617 nt, Artificial Sequence
  derived and/or modified sequence opt1 from VP1__Norovirus_and/or_Norovirus-like__AB541280
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgccgcccugggccccgaccucaacccguaccugucccaccuggcccgcauguacaacggcuacgccgggggcuucgaggugcaggucauccucgcggggaacgccuucacggccggcaagaucaucuucgccgccgugccgcccaacuuccccaccgaggggcugagcccgucccaggugaccauguucccccacaucaucgucgacgugcggcagcuggagcccgugcucaucccccugccggacguccgcaacaacuucuaccacuacaaccagagcaacgacuccaccaucaagcugaucgcgaugcucuacacgccccugcgggccaacaacgccggcgaggacguguucaccgugagcugccgcguccugacccggcccucccccgacuucgacuucaucuuccucgugccgcccaccguggagagccgcacgaagcccuucaccguccccauccugaccguggaggagaugaccaacucccgguucccgaucccccuggagaagcuguucacgggccccagcggggccuucgugguccagccccagaacggccgcugcaccaccgacggggugcugcugggcaccacgcagcucuccccggucaacaucugcaccuuccggggcgacgugacccacaucgccgggagccgcaacuacaccaugaaccuggcgucccugaacuggaacaacuacgaccccacggaggagauccccgccccgcucggcacccccgacuucguggggaagauccagggcguccugacccagaccacgaagggggacggcagcacccggggccacaaggccaccguguacaccggguccgcccccuucacgcccaagcugggcagcgugcaguucagcaccgacaccgagaacgacuucgagacccaccagaacacgaaguucaccccggucggggugauccaggacggcuccaccacccaccgcaacgagccccagcagugggugcuccccagcuacuccgggcggaacguccacaacgugcaccuggcccccgcgguggccccgacguuccccggcgagcagcuccucuucuuccgcagcaccaugcccggcugcuccggguaccccaacauggaccuggacugccugcucccgcaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcuga

SEQ ID NO: 11572 - RNA, 1617 nt, Artificial Sequence
  derived and/or modified sequence opt1 from VP1__Norovirus_and/or_Norovirus-like__AB541244
augaagauggccagcaacgacgccaaccccuccgacggcagcgcggccaaccuggugccggaggucaacaacgaggggauggcccucgagcccguggugggcgccgccaucgcggcccccgucgccgggcagaccaacgugaucgaccccuggauccgcaacaacuucgugcaggccccgggcggggaguucaccgucagcccccggaacgcgcccuccgagauccugugguccgccagccugggccccgaccucaacccguaccugucccaccuggcccgcauguacaacggcuacgccgggggcuucgagguccaggugauccucgccgggaacgcguucacggccggcaagaucaucuucgccgccgugccgcccaacuuccccaccgaggggcugagccccucccaggugaccauguucccccacaucaucguggacguccggcagcuggagcccgugcucaucccccugccggacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccucccccgacuucgacuucaucuuccucgucccgcccaccguggagagccgcacgaagcccuucaccgugcccauccugaccgucgaggagaugaccaacucccgguucccgaucccccuggagaagcuguucacgggccccagcggggccuucguggugcagccccagaacggccgcugcaccaccgacgggguccugcugggcaccacgcagcucuccccggugaacaucugcaccuuccggggcgacgucacccacaucgccgggagccgcaacuacaccaugaaccuggccucccugaacuggaacaacuacgaccccacggaggagauccccgcgccgcucggcacccccgacuucguggggaagauccagggcgugcugacccagaccacgaaggggaacggcagcacccggggccacaaggccaccgucuacaccgggagcgcccccuucacgcccaagcugggcuccgugcaguucagcaccgacaccgagaacgacuucgagacccaccagaacacgaaguucaccccggugggggucauccaggacggcuccaccacccaccgcaacgagccccagcagugggugcuccccagcuacuccgggcggagcgugcacaacguccaccuggcccccgccguggcgccgacguuccccggcgagcagcuccucuucuuccgcuccaccaugcccggcugcagcggguaccccaacauggaccuggacugccugcucccgcaggagugggugcagcacuucuaccaggaggccgcccccgcccaguccgacgucgcgcugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacgcucgcccccaugggcaacggcaccgggcgccggcgcuga

SEQ ID NO: 11573 - RNA, 1617 nt, Artificial Sequence
  derived and/or modified sequence opt1 from VP1__Norovirus_and/or_Norovirus-like__AB541203
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucguggggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgaggcccaccagaacaccaaguucacgcccgugggggugauccaggacggcuccaccacccaccgcaacgagccccagcaguggguccuccccagcuacuccgggcggaacgugcagaacgugcaccuggccccggccgucgcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcuga

SEQ ID NO: 11574 - RNA, 1617 nt, Artificial Sequence
  derived and/or modified sequence opt1 from VP1__Norovirus_and/or_Norovirus-like__GQ850882
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccgucuucaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcugcccaacuacagcggccgcaccgggcacaacgugcaccucgcgcccgccgucgccccgaccuaccccggcgagcagcugcuguucuuccgguccacgaugcccggcugcagcggguaccccaacauggaccucgacugccugcugccgcaggagugggugcagcacuucuaccaggaggccgcgcccgcccaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacggcacggggcgccggcgcuga

SEQ ID NO: 11575 - RNA, 1617 nt, Artificial Sequence
  derived and/or modified sequence opt1 from VP1__Norovirus_and/or_Norovirus-like__KR131772
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggccacccagaacuggaacagcuacgacccgaccgaggagauccccgcgccccuggggacccccgacuucgugggcaagauccaggggguccucacgcagaccacccgggccgacggcuccacccgcgggcacaaggccacgguguacaccggcagcgccgacuucgccccgaagcugggccgggugcaguucgccaccgacaccgacaacgacuucgacgccaaccagaacacgaaguucacccccgucggggugauccaggacggcaacaccgcgcaccgcaacgagccccagcagugggugcugcccagcuacuccgggcggaacagccacaacguccaccucgccccggccguggcccccaccuuccccggcgagcagcugcuguucuuccgcuccacgaugcccgggugcagcggcuacccgaacauggaccucgacugccugcugccccaggagugggugcaguacuucuaccaggaggcggcccccgcccaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggacgggccgccgccgguga

SEQ ID NO: 11576 - RNA, 1617 nt, Artificial Sequence
  derived and/or modified sequence opt1 from VP1__Norovirus_and/or_Norovirus-like__KR904215
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacgugacgcacaccaccggcagccacaacuacaccaugaaccuggccacgcagaacugguccagcuacgacccgaccgaggagauccccgcgccccuggggacccccgacuucgugggcaagauccaggggguccucacccagacgaccaagaccgacggcagcacccgcgggcacaaggccacgguguacaccggcuccgccgacuucgccccgaagcugggccgggugcaguucgccaccgacaccgacaacgacuucgaggccaaccagaacacgaaguucacccccgucggggugauccaggacggcaacaccgcgcaccgcaacgagccccagcagugggugcugcccagcuacuccgggcggaacacccacaacguccaccucgccccggccguggcccccacguuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucaccguggcccacaccggcccgcacgaccuggugaucccgcccaacggguacuuccgguucgacagcugggucaaccaguucuacacgcuggcgcccaugggcaacgggaccggccgccggcgcuga

SEQ ID NO: 11577 - RNA, 1617 nt, Artificial Sequence
  derived and/or modified sequence opt1 from VP1__Norovirus_and/or_Norovirus-like__AB933715
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucggcacggacaccgagaacgacuucgagacccaccagaacaccaaguucacgcccgucggggugauccaggacggcgggaccacccaccgcaacgagccccagcagugggugcuccccuccuacagcggccggaacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11578 - RNA, 1617 nt, Artificial Sequence
  derived and/or modified sequence opt1 from VP1__Norovirus_and/or_Norovirus-like__AB933695
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccacaacuacaccaugagccuggccucccugaacuggaacaacuacgaccccaccgaggagaucccggcgccccucgggacccccgacuucgugggcaagauccaggggguccugacgcagaccaccaagggcgacgggagcacccgcggccacaaggccacgguguacaccggcagcgcccccuucaccccgaagcugggguccgugcaguucagcaccgacacggagaacgacuucgagacccaccagaacaccaaguucacccccgucggcgugauccaggacgggggcacgacccaccggaacgagccccagcagugggugcuccccuccuacagcgggcgcaacgucccgaacgugcaccuggcccccgccguggcgcccaccuuccccggcgagcagcuccucuucuuccgguccaccaugccgggcugcagcggguaccccaacauggaccuggacugccugcucccccaggaguggguccagcacuucuaccaggaggccgcccccgcccaguccgacguggcgcugcugcgcuucgugaacccggacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgguga

SEQ ID NO: 11579 - RNA, 1617 nt, Artificial Sequence
  derived and/or modified sequence opt1 from VP1__Norovirus_and/or_Norovirus-like__AB933681
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacgccaaguucacccccgucggcgugauccaggacgggagcacgacccaccgcaacgagccccagcagugggugcuccccuccuacagcggccggaacgucccgaacgugcaccuggcccccgcgguggcccccaccuuccccggggagcagcuccucuucuuccgcuccaccaugccgggcugcagcggcuaccccaacauggaccuggacugccugcucccccaggaguggguccagcacuucuaccaggaggccgcccccgcgcaguccgacguggcccugcugcgguucgugaacccggacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcuga

SEQ ID NO: 11580 - RNA, 1617 nt, Artificial Sequence
  derived and/or modified sequence opt1 from VP1__Norovirus_and/or_Norovirus-like__AB933675
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccaacucccacaacuacaccaugaaccuggccagccugaacuggaacaacuacgaccccaccgaggagaucccggcgccccucggcacgcccgacuucgucgggaagauccagggcgugcugacccagaccaccaagggggacggcuccacgcgcgggcacaaggccaccguguacaccggcagcgcccccuucaccccgaagcugggcagcguccaguucuccacggacaccgagaacgacuucgagacccaccagaacaccaaguucacgcccgugggggugauccaggacggcgggaccacccaccggaacgagccccagcaguggguccuccccagcuacuccggccgcaacgugcagaacgugcaccuggccccggccgucgcgcccaccuuccccggggagcagcuccucuucuuccggagcacgaugcccggcugcuccggcuacccgaacauggaccuggacugccugcucccccaggagugggugcagcacuucuaccaggaggccgcccccgcccagagcgacguggcgcugcugcgcuucgucaaccccgacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccggcgccgguga

SEQ ID NO: 11581 - RNA, 1617 nt, Artificial Sequence
  derived and/or modified sequence opt1 from VP1__Norovirus_and/or_Norovirus-like__AB933652
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccacguucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucggcaccgacaccgagaacgacuucgagacccaccagaacacgaaguucacccccgucggggugauccaggacggcgggaccacccaccgcaacgagccccagcagugggugcuccccuccuacagcggccggaacgucccgaacgugcaccuggcccccgccguggcccccacguuccccggcgagcagcuccucuucuuccgcuccaccaugccggggugcagcggcuaccccaacauggaccuggacugccugcucccccaggaguggguccagcacuucuaccaggaggcggcccccgcccaguccgacguggcccugcugcgguucgugaacccggacaccgggcgcguccucuucgagugcaagcugcacaagagcggcuacgugaccguggcgcacaccgggcagcacgaccuggucaucccgcccaacggcuacuuccgguucgacuccugggugaaccaguucuacacgcucgcccccaugggcaacgggaccggccgccggcgcuga

SEQ ID NO: 11582 - RNA, 1617 nt, Artificial Sequence
  derived and/or modified sequence opt1 from VP1__Norovirus_and/or_Norovirus-like__KF429762
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucaccggcagccgcaacuacaccaugaaccuggccucccagaacuggaacagcuacgaccccacggaggagaucccggcgccccuggggacccccgacuucgugggcaagauccaggggguccucacccagaccacgcggaccgacggcagcacccgcgggcacaaggccaccguguacacgggcuccgccgacuucagccccaagcugggccgggugcaguucgccaccgacaccgacaacgacuucgacgccaaccagaacaccaaguucacgccggucggggugauccaggacggcgggaccacccaccgcaacgagccccagcagugggugcugcccuccuacagcggccggaacacccacaacguccaccucgcccccgccguggcgccgacguuccccggggagcagcugcuguucuuccgcuccaccaugcccggcugcagcggcuaccccaacauggaccucgacugccugcugccgcaggagugggugcagcacuucuaccaggaggccgcccccgcccaguccgacgucgcgcuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgguga

SEQ ID NO: 11583 - RNA, 1617 nt, Artificial Sequence
  derived and/or modified sequence opt1 from VP1__Norovirus_and/or_Norovirus-like__JX644027
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagcaagaccaagcccuucacgguccccauccugaccguggaggagaugaccaacucccgcuuccccaucccccuggagaagcuguucaccggccccagcuccgccuucgugguccagccgcagaacgggcggugcacgaccgacggcgugcugcuggggaccacccagcucagccccgucaacaucugcacguuccgcggcgacgugacccacaucgccggcucccggaacuacaccaugaaccuggccagccugaacuggaacaacuacgaccccaccgaggagaucccggcgccccucgggacgcccgacuucgugggcaagauccaggggguccugacccagaccaccaagggcgacggguccacgcgcggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccggaacgagccccagcagugggugcuccccuccuacagcggccgcaacgcccagaacguccaccuggccccggcgguggcccccaccuuccccggggagcagcuccucuucuuccgguccacgaugcccggcugcagcggcuacccgaacauggaccuggacugccugcucccccaggagugggugcagcacuucuaccaggaggccgcccccgcgcaguccgacgucgcccugcugcgcuucgugaaccccgacaccgggcggguccucuucgagugcaagcugcacaagagcggcuacgugaccguggcccacaccgggcagcacgaccuggugaucccgcccaacggcuacuuccgcuucgacuccugggucaaccaguucuacacccucgcccccauggggaacggcacgggccggcgccgguga

SEQ ID NO: 11584 - RNA, 1617 nt, Artificial Sequence
  derived and/or modified sequence opt1 from VP1__Norovirus_and/or_Norovirus-like__JN400617
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccagaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11585 - RNA, 1617 nt, Artificial Sequence
  derived and/or modified sequence opt1 from VP1__Norovirus_and/or_Norovirus-like__JQ613519
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacgggaacaccacccaccgcaacgagccccagcagugggugcuccccuccuacagcggccggaacguccacaacgugcaccuggcccccgccguggccccgaccuuccccggggagcagcuccucuucuuccgcuccacgaugcccggcugcagcggcuaccccaacauggaccuggacugccugcucccgcaggaguggguccagcacuucuaccaggaggccgcgcccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11586 - RNA, 1617 nt, Artificial Sequence
  derived and/or modified sequence opt1 from VP1__Norovirus_and/or_Norovirus-like__HQ456341
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcguguuccucgggaccacccagcugagccccgucaacaucugcacguuccggggcgacgugacccacaucaccggcucccgcaacuacaccaugaaccucgccacgcagaacuggaacagcuacgacccgaccgaggagauccccgcgccccuggggacccccgacuucgugggcaagauccaggggguccugacccagacgacccgggccgacggcagcacccgcgggcacaaggccaccguguacacgggcuccgccgacuucgccccgaagcucggccgggugcaguucgccaccgacaccgacaacgacuucgacgccaaccagaacaccaaguucacgcccgucggggugauccaggacggcgacaccgcgcaccgcaacgagccccagcagugggugcugcccagcuacuccgggcggaacagccacaacguccaccuggccccggccguggcccccaccuuccccggcgagcagcuccuguucuuccgcuccaccaugcccgggugcagcggcuacccgaacauggaccuggacugccuccugccccaggagugggugcaguacuucuaccaggaggcggcccccgcccaguccgacgucgcccugcuccgguucgugaaccccgacacgggccgcgugcuguucgagugcaagcugcacaagagcggguacgucaccguggcccacaccggccagcacgaccucgugaucccgcccaacggguacuuccgguucgacuccugggucaaccaguucuacacccuggcgcccaugggcaacgggaccggccgccgccgguga

SEQ ID NO: 11587 - RNA, 1617 nt, Artificial Sequence
  derived and/or modified sequence opt1 from VP1__Norovirus_and/or_Norovirus-like__HM802540
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcugcuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccagcuguccaccgacaccagcaacgacuucgagacggggcagaacacccgguucacccccgugggcgugguccaggacggguccaccacgcaccagaacgagccccagcagugggugcuccccgacuacagcggccgcgacucccacaacgugcaccuggccccggccgucgcccccaccuuccccggggagcagcuccucuucuuccggagcaccaugcccggcugcuccggcuacccgaacaugaaccuggacugccugcucccccaggagugggugcagcacuucuaccaggagagcgcccccgcgcaguccgacguggcccugcugcgcuucgucaaccccgacaccgggcggguccucuucgagugcaagcugcacaagagcggcuacgugaccguggcccacacggggcagcacgaccuggugaucccgcccaacggcuacuuccgcuucgacuccugggugaaccaguucuacacccucgcccccauggggaacggcgcgggccggcgccgcuga

SEQ ID NO: 11588 - RNA, 1617 nt, Artificial Sequence
  derived and/or modified sequence opt1 from VP1__Norovirus_and/or_Norovirus-like__AB541257
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacgcccagaacguccaccuggcgccggccguggcccccaccuuccccggcgagcagcuccucuucuuccgcagcacgaugcccggcugcuccggguacccgaacauggaccuggacugccugcucccccaggagugggugcagcacuucuaccaggaggccgcgcccgcccagagcgacgucgcccugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11589 - RNA, 1617 nt, Artificial Sequence
  derived and/or modified sequence opt1 from VP1__Norovirus_and/or_Norovirus-like__AB541242
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccagccugggccccgaccucaacccguaccugucccaccuggcccgcauguacaacggcuacgccgggggcuucgaggugcaggucauccucgccgggaacgcguucaccgccggcaagaucaucuucgccgccgugccgcccaacuuccccacggaggggcugagcccgucccaggugaccauguucccccacaucaucgucgacgugcggcagcuggagcccgugcucaucccccugccggacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccucccccgacuucgacuucaucuuccucgugccgcccaccguggagagccgcaccaagcccuucacgguccccauccugaccguggaggagaugaccaacucccgguucccgaucccccuggagaagcuguucaccggccccagcuccgccuucgugguccagccccagaacgggcgcugcacgaccgacggcgugcugcuggggaccacccagcucagcccggucaacaucugcacguuccggggcgacgugacccacaucgccggcucccgcaacuacaccaugaaccuggccagccugaacuggaacaacuacgaccccaccgaggagauccccgcgccgcucgggacgcccgacuucgugggcaagauccaggggguccugacccagaccaccaagggcgacgggagcacgcggggccacaaggccaccguguacaccggcuccgcccccuucacccccaagcuggggagcgugcaguucuccacggacaccgagaacgacuucgagacccaccagaacaccaaguucacgccggucggcgugauccaggacgggggcaccacccaccgcaacgagccccagcagugggugcuccccagcuacuccgggcggaacguccagaacgugcaccuggcccccgccguggcgccgaccuuccccggcgagcagcuccucuucuuccgcagcacgaugcccggcugcuccggguaccccaacauggaccuggacugccugcucccgcaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11590 - RNA, 1617 nt, Artificial Sequence
  derived and/or modified sequence opt1 from VP1__Norovirus_and/or_Norovirus-like__AB541225
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccggcgacgacuuccagacccaccagaacaccaaguucacgcccgucggggugauccaggacggcgggaccacccaccgcaacgagccccagcagugggugcuccccuccuacagcggccggaacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaaggccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 11591 - RNA, 1617 nt, Artificial Sequence
  derived and/or modified sequence opt1 from VP1__Norovirus_and/or_Norovirus-like__AB541190
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccuguucuuccgguccacgaugcccggcugcagcggguaccccaacauggaccuggacugccugcucccgcaggagugggugcagcacuucuaccaggaggccgcgcccgcccaguccgacauggcccugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcgccggcgcuga

SEQ ID NO: 11592 - RNA, 1617 nt, Artificial Sequence
  derived and/or modified sequence opt1 from VP1__Norovirus_and/or_Norovirus-like__AB492092
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucuccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgguga

SEQ ID NO: 11593 - RNA, 1617 nt, Artificial Sequence
  derived and/or modified sequence opt1 from VP1__Norovirus_and/or_Norovirus-like__EU916956
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacaccaaguucacccccgugggcgugguccaggacggguccaccacgcaccagaacgagccccagcagugggugcugcccgacuacagcggccgggacucccacaacgugcaccucgccccggccgucgcccccaccuuccccggggagcagcugcuguucuuccgcagcaccaugcccggcugcuccggcuacccgaacaugaaccucgacugccugcugccccaggagugggugcagcacuucuaccaggagagcgcccccgcgcaguccgacguggcccuccugcgguucgucaaccccgacaccgggcgcgugcuguucgagugcaagcuccacaagagcggcuacgugaccgucgcccacacggggcagcacgaccuggugaucccgcccaacggcuacuuccgguucgacuccugggugaaccaguucuacacccuggcccccauggggaacggcgcgggccgccggcgcuga

SEQ ID NO: 11594 - RNA, 1617 nt, Artificial Sequence
  derived and/or modified sequence opt1 from VP1__Norovirus_and/or_Norovirus-like__EF126962
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgauccggcugaucgccaugcucuacacgccccugcgcgccaacaacgcgggcgacgacguguucaccguguccugccggguccugacccgcccgagccccgacuucgacuucaucuuccucgugccgcccaccguggagucccggaccaagcccuucagcguccccauccugaccguggaggagaugaccaacucccgcuuccccaucccccuggagaagcuguucacgggcccgagcuccgccuucgugguccagccccagaacgggcggugcaccaccgacggcgugcuccuggggaccacgcagcucagccccgucaacaucugcaccuuccgcggcgacgugacccacaucgccggcacccagaacuacacgaugaaccuggccucccagaacuggaacaacuacgacccgaccgaggaggugcccgcgccccuggggacccccgacuucgucggcaagauccagggggugcucacccagacgacccggggcgacgggagcacccgcggccacaaggccaccguguccacgggcagcguccacuucaccccgaagcuggggagcgugcaguucuccaccgacaccagcaacgacuucgagacgggccagaacacccgguucacccccgugggggucgugcaggacggcuccaccacgcaccagaacgagccccagcagugggugcugcccgacuacagcgggcgcgacaaccacaacguccaccucgccccggccguggcccccaccuuccccggcgagcagcugcuguucuuccgguccaccaugcccggcugcagcggguacccgaacaugaaccucgacugccugcugccccaggagugggugcagcacuucuaccaggaguccgcccccgcgcagagcgacgucgcccuccugcgcuucgugaaccccgacaccggccgggugcuguucgagugcaagcuccacaaguccggguacgucaccguggcccacacgggccagcacgaccuggugaucccgcccaacggguacuuccgcuucgacagcugggucaaccaguucuacacccuggcccccaugggcaacggcgcggggcggcgccgcuga

SEQ ID NO: 11595 - RNA, 1617 nt, Artificial Sequence
  derived and/or modified sequence opt1 from VP1__Norovirus_and/or_Norovirus-like__AB663687
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucggcacggacaccgagaacgacuucgagacccaccagaacaccaaguucacgccggucggggugauccaggacggcuccaccacccaccgcaacgagccccagcagugggugcuccccagcuacuccgggcggaacguccacaacgugcaccuggcccccgccguggcgccgaacuuccccggcgagcaguuccuguucuuccgcagcaccaugcccggcugcuccggguaccccaacauggaccucgacugccugcugccgcaggaguggguccagcacuucuaccaggaggccgcccccgcccagagcgacguggcgcuccugcgguucgugaaccccgacacgggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacggcaccgggcgccggcgcuga

SEQ ID NO: 11596 - RNA, 1617 nt, Artificial Sequence
  derived and/or modified sequence opt1 from VP1__Norovirus_and/or_Norovirus-like__AB933759
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgguga

SEQ ID NO: 11597 - RNA, 1617 nt, Artificial Sequence
  derived and/or modified sequence opt1 from VP1__Norovirus_and/or_Norovirus-like__AB933755
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccacguucgugguccagccccagaacgggcgcugcaccaccgacggcgugcuccuggggaccacgcagcucagccccgucaacaucugcaccuuccggggcgacgugacccacaucaccggcucccacaacuacacgaugaaccuggcgagccagaacuggaacagcuacgacccgaccgaggagauccccgcgccccuggggacccccgacuucgugggcaagauccaggggguccucacccagacgacccgcaccgacggcuccacccgggggcacaaggccacgguguacaccggcagcgccgaguucuccccgaagcugggccgcgugcaguucgccaccgacaccaacaacgacuucgacgccaaccagaacacgaaguucacccccgucggggugauccaggacggcgggaccacccaccggaacgagccccagcagugggugcugcccagcuacuccggccgcaacacgcacaacguccaccucgccccggccguggcccccaccuuccccggggagcagcugcuguucuuccggagcaccaugcccggcugcuccggcuacccgaacauggaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacacggggcagcacgaccuggugaucccgcccaacggcuacuuccgcuucgacagcugggucaaccaguucuacacccuggcgcccauggggaacggcaccggccggcgccgcuga

SEQ ID NO: 11598 - RNA, 1617 nt, Artificial Sequence
  derived and/or modified sequence opt1 from VP1__Norovirus_and/or_Norovirus-like__AB933677
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccuccagccgcaacuacaccaugaaccuggccucccugaacuggaacaacuacgaccccaccgaggagaucccggcgccccucggcacccccgacuucguggggaagauccagggcguccugacgcagaccaccaagggggacggcagcacccgggggcacaaggccacgguguacaccggcagcgcccccuucaccccgaagcugggcuccgugcaguucagcaccgacacggagaacgacuucgagacccaccagaacaccaaguucacccccgucggggugauccaggacggcgggacgacccaccgcaacgagccccagcagugggugcuccccuccuacagcggccggaacgucccgaacgugcaccuggcccccgccguggcgcccaccuuccccggggagcagcuccucuucuuccgcuccaccaugccgggcugcagcggcuaccccaacauggaccuggacugccugcucccccaggaguggguccagcacuucuaccaggaggccgcccccgcccaguccgacguggcgcugcugcgguucgugaacccggacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcuga

SEQ ID NO: 11599 - RNA, 1617 nt, Artificial Sequence
  derived and/or modified sequence opt1 from VP1__Norovirus_and/or_Norovirus-like__AB933650
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacguccagaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11600 - RNA, 1617 nt, Artificial Sequence
  derived and/or modified sequence opt1 from VP1__Norovirus_and/or_Norovirus-like__KM245071
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11601 - RNA, 1617 nt, Artificial Sequence
  derived and/or modified sequence opt1 from VP1__Norovirus_and/or_Norovirus-like__KF712497
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggagcaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcugggguccauccaguucgccacggacaccgagaacgacuucgagacccaccagaacacccgcuucacgccggugggcgucauccaggacgggggcaccacccaccggaacgagccccagcagugggugcuccccagcuacuccgggcgcaacgugcacaacguccaccuggcccccgcgguggccccgaacuuccccggcgagcagcuccucuucuuccggagcaccaugcccggcugcuccggguaccccaacauggaccuggacugccugcucccgcaggagugggugcagcacuucuaccaggaggccgcccccgcgcagagcgacgucgcccugcugcgcuucgugaaccccgacacgggccggguccucuucgagugcaagcugcacaaguccggguacgugaccguggcccacaccggccagcacgaccuggugaucccgcccaacggguacuuccgcuucgacagcugggucaaccaguucuacacccucgcccccaugggcaacggcaccgggcggcgccgcuga

SEQ ID NO: 11602 - RNA, 1617 nt, Artificial Sequence
  derived and/or modified sequence opt1 from VP1__Norovirus_and/or_Norovirus-like__KC990829
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcuccucuucuuccgcagcaccaugcccggcugcuccggcuaccccaacacggaccuggacugccugcucccgcaggaguggguccagcacuucuaccaggaggccgcccccgcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11603 - RNA, 1617 nt, Artificial Sequence
  derived and/or modified sequence opt1 from VP1__Norovirus_and/or_Norovirus-like__JX439843
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucccgcccgucaacaucugcacguuccggggcgacgugacccacaucgccggcucccgcguguacaccaugaaccuggccagccugaacuggaacaacuacgaccccaccgaggagauccccgcgccccucgggacgcccgacuucgucggcaagauccagggggugcugacccagaccaccaaggaggacggcuccacgcgggggcacaaggccaccguguacaccggcagcgccccguucacccccaagcugggcagcguccaguucuccacggacaccgagaacgacuucgagacccaccagaacaccaaguucacgcccgugggggugauccaggacggcgggaccacccaccgcaacgagccccagcaguggguccucccgagcuacuccggccggaacgcccccaacgugcaccuggcccccgcgguggcccccaccuucccgggggagcagcuccucuucuuccgcagcacgaugcccggcugcuccggcuaccccaacauggaccuggacugccugcucccccaggaguggguccagcacuucuaccaggaggccgccccggcgcagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11604 - RNA, 1617 nt, Artificial Sequence
  derived and/or modified sequence opt1 from VP1__Norovirus_and/or_Norovirus-like__JX439841
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcacccccuucacgccgaagcugggguccgugcaguucagcaccgacaccgagaacgacuucgagacccaccagaacacgaaguucacccccgucggcgugauccaggacgggggcaccacccaccgcaacgagccccagcagugggugcuccccuccuacagcgggcggaacguccagaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcuga

SEQ ID NO: 11605 - RNA, 1617 nt, Artificial Sequence
  derived and/or modified sequence opt1 from VP1__Norovirus_and/or_Norovirus-like__JX439830
augaagaugggcagcaacgacgccaaccccuccgacgggagcaccgccaaccuggugccggaggucaacaacgaggugauggcgcucgagcccguggucggcgccgccaucgccgcccccguggcggggcagcagaacgugaucgaccccuggauccgcaacaacuucguccaggccccgggcggggaguucaccgugagcccccggaacgcccccggcgagauccugugguccgcgccccugggcccggaccucaaccccuaccugucccaccuggcccgcauguacaacggguacgccggcggguucgaggugcaggucauccucgccggcaacgccuucacggccgggaagaucaucuucgcggccgugccgcccaacuuccccaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccgggccgagcuccgcguucgugguccagccccagaacggccgcugcacgaccgacggggugcuccugggcaccacccagcucagccccgucaacaucugcacguuccggggcgacgugacccacaucaccgggucccgcaacuacaccaugaaccuggccacgcagaacuggaacagcuacgacccgaccgaggagauccccgcgccccugggcacccccgacuucguggggaagauccagggcguccucacccagacgacccgggccgacggguccacccgcggccacaaggccaccguguacacgggcagcgccgacuucgccccgaagcuggggcgggugcaguucgccaccgacaccgacaacgacuucgacgccaaccagaacaccaaguucacgcccgucggcgugauccaggacggggacaccgcccaccgcaacgagccccagcagugggugcugcccagcuacuccggccggaacagccacaacguccaccucgcgccggccguggcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgguga

SEQ ID NO: 11606 - RNA, 1617 nt, Artificial Sequence
  derived and/or modified sequence opt1 from VP1__Norovirus_and/or_Norovirus-like__JX439828
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccacgcagaacuggaacuccuacgacccgaccgaggagauccccgcgccccuggggacccccgacuucgucggcaagauccagggggugcucacccagacgacccgggccgacggcagcacccgcgggcacaaggccaccguguacacgggcagcgccgacuucgccccgaagcugggccggguccaguucgccaccgacaccgacaacgacuucgacgccaaccagaacaccaaguucacgcccgugggggugauccaggacggcgacaccgcgcaccgcaacgagccccagcaguggguccugcccuccuacagcgggcggaacucccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacacgggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggaccggccgccgccgguga

SEQ ID NO: 11607 - RNA, 1617 nt, Artificial Sequence
  derived and/or modified sequence opt1 from VP1__Norovirus_and/or_Norovirus-like__JX445153
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcugcuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccugggggcccccgacuucgugggcaagauccaggggguccucacccagaccacgcgcggcgacgggagcacccggggccacaaggccaccguguccaccggcagcgugcacuucacgccgaagcuggggagcguccaguucuccaccgacaccagcaacgaccuggagaccggccagaacacgcgcuucacccccgugggggugguccaggacggcuccaccacccaccagaacgagccccagcagugggugcuccccaacuacagcgggcgggacucccacaacgugcaccuggccccggccgucgcccccacguuccccggcgagcagcuccucuucuuccgcagcaccaugcccggcugcuccggguacccgaacaugaaccuggacugccugcucccccaggagugggugcagcacuucuaccaggagagcgcgcccgcccaguccgacguggcccugcugcgguucgucaaccccgacaccggccgcguccucuucgagugcaagcugcacaagagcggguacgugaccguggcccacaccggccagcacgaccuggugaucccgcccaacggguacuuccgguucgacuccugggugaaccaguucuacacgcucgcgcccaugggcaacggcgccgggcgccggcgcuga

SEQ ID NO: 11608 - RNA, 1617 nt, Artificial Sequence
  derived and/or modified sequence opt1 from VP1__Norovirus_and/or_Norovirus-like__JX155754
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcggggccacaaggccaccguguacaccggcuccgccccguucacccccaagcuggggagcgugcaguucagcacggacaccgagaacgacuucgagacccaccagaacaccaaguucacgcccgucggcgugauccaggacgggggcaccacccaccgcaacgagccccagcagugggugcucccguccuacagcgggcgggacguccccaacgcccaccuggcccccgcgguggcccccaccuucccgggcgagcagcuccucuucuuccgcuccacgaugcccggcugcagcggguaccccaacauggaccuggacugccugcucccccaggagugggugcagcacuucuaccaggaggccgccccggcgcaguccgacgucgcccugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 11609 - RNA, 1617 nt, Artificial Sequence
  derived and/or modified sequence opt1 from VP1__Norovirus_and/or_Norovirus-like__JN400608
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccacaacuacaccaugaaccuggccagccugaacuggaacaacuacgaccccaccgaggagaucccggcgccccucgggacgcccgacuucgugggcaagauccaggggguccugacccagaccaccaagggcgacggguccacgcgcggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccggaacgagccccagcagugggugcuccccuccuacagcggcgggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11610 - RNA, 1617 nt, Artificial Sequence
  derived and/or modified sequence opt1 from VP1__Norovirus_and/or_Norovirus-like__EF187497
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgaggacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcacgaucgucgugcagccccagaacgggcgcugcaccaccgacggcguccuccuggggaccacgcagcucucccccgugaacaucugcaccuuccggggcgacgugacccacaucgccggcacccaggaguacacgaugaaccuggccagccagaacuggaacaacuacgacccgaccgaggagauccccgcgccccuggggacccccgacuucgucggcaagauccagggggugcucacccagacgacccgccgggacggcuccacccgcgggcacaaggccaccgugagcacgggcagcgucaacuucaccccgaagcugggccggauccaguucuccaccgacaccagcaacgacuucgagacggggcaguccacccgcuucacccccgugggcgugguccaggacgggagcaccacgcaccagaacgagccccagcagugggugcugcccgacuacuccggccgggacagccacaacgugcaccucgccccggccgucgcccccuccuuccccggggagcagcugcuguucuuccgcagcaccaugcccggcugcuccggcuacccgaacaugaaccucgacugccugcugccccaggagugggugcagcacuucuaccaggaggccgcccccgcgcagagcgacguggcccuccugcgguucgucaaccccgacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacgcuggcccccauggggaacggcaccggccgccgccgguga

SEQ ID NO: 11611 - RNA, 1617 nt, Artificial Sequence
  derived and/or modified sequence opt1 from VP1__Norovirus_and/or_Norovirus-like__AB668028
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggccggaacguccacaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11612 - RNA, 1617 nt, Artificial Sequence
  derived and/or modified sequence opt1 from VP1__Norovirus_and/or_Norovirus-like__HM802542
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggccgcauccaggggguccucacccagacgacccggcgcgacggcagcacccgggggcacaaggccaccguguccacgggcagcgugcacuucaccccgaagcugggcagcguccaguucuccaccgacaccagcaacgacuucgagacggggcagaacacccgcuucacccccgugggcgugguccaggacggguccaccacgcaccagaacgagccccagcagugggugcugcccgacuacagcggccgggacucccacaacgugcaccucgccccggccgucgcccccaccuuccccggggagcagcugcuguucuuccgcagcaccaugcccggcugcuccggcuacccgaacaugaaccucgacugccugcugccccaggagugggugcagcacuucuaccaggagagcgcccccgcgcaguccgacguggcccuccugcgguucgucaaccccgacaccgggcgcgugcuguucgagugcaagcuccacaagagcggcuacgugaccgucgcccacacggggcagcacgaccuggugaucccgcccaacggcuacuuccgguucgacuccugggugaaccaguucuacacccuggcccccauggggaacggcgcgggccgccgccgguga

SEQ ID NO: 11613 - RNA, 1617 nt, Artificial Sequence
  derived and/or modified sequence opt1 from VP1__Norovirus_and/or_Norovirus-like__HQ009513
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgguga

SEQ ID NO: 11614 - RNA, 1617 nt, Artificial Sequence
  derived and/or modified sequence opt1 from VP1__Norovirus_and/or_Norovirus-like__AB541322
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccgaccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 11615 - RNA, 1617 nt, Artificial Sequence
  derived and/or modified sequence opt1 from VP1__Norovirus_and/or_Norovirus-like__AB541321
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccagaacgcccccuccgagauccugugguccgcgccccuggggccggaccucaaccccuaccugagccaccuggcccggauguacaacggcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcgccagcuggagcccgugcucaucccgcugcccgacguccggaacaacuucuaccacuacaaccaguccaacgaccccaccaucaagcugaucgccaugcucuacacgccccugcgcgccaacaacgcgggggacgacguguucaccgugagcugccggguccugacccgcccgucccccgacuucgacuucaucuuccucgugccgcccaccguggagagccggacgaagcccuucaccguccccauccugaccguggaggagaugaccaacucccgcuuccccaucccccuggagcggcucuacacgggcccgagcuccgccuucgugguccagccccagaacggccgcugcaccaccgacggggugcugcugggcaccacgcagcucagcgccgucaacaucugcaccuuccgcggggacgugacccacaucgccggcucccggaacuacaccaugaaccuggccagccagaacuggaacaacuacgaccccacggaggagaucccggcgccccugggcacccccgacuucguggggaagauccagggcaugcucacccagaccacgcgguccgacgggagcacccgcggccacaaggccaccguccugaccgggagcgccgacuucgcccccaagcugggccgggugcaguucgccacggacaccgacaacgacuucgaguccggccagaacaccaaguucaccccggugggggucauccaggacggcagcacgacccaccgcaacgagccccagcagugggugcuccccaacuacuccgggcggaccggccacaacgugcaccuggcgcccgccgucgccccgaccuaccccggggagcagcuccucuucuuccgcagcacgaugcccggcugcuccggcuaccccaacauggaccuggacugccugcucccgcaggagugggugcagcacuucuaccaggaggccgcgcccgcccagagcgacguggcccugcugcgguucgucaaccccgacaccgggcgcgugcuguucgagugcaagcugcacaaguccggcuacgugaccgucgcccacaccgggcagcacgaccuggugaucccgcccaacggcuacuuccgguucgacagcugggugaaccaguucuacacccucgcccccauggggaacggcacgggccgccgccgguga

SEQ ID NO: 11616 - RNA, 1617 nt, Artificial Sequence
  derived and/or modified sequence opt1 from VP1__Norovirus_and/or_Norovirus-like__AB541253
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11617 - RNA, 1617 nt, Artificial Sequence
  derived and/or modified sequence opt1 from VP1__Norovirus_and/or_Norovirus-like__AB541250
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccaggacaccaaguucacgcccgucggcgugauccaggacgggggcaccacccaccgcaacgagccccagcagugggugcuccccuccuacagcgggcggaacguccagaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11618 - RNA, 1617 nt, Artificial Sequence
  derived and/or modified sequence opt1 from VP1__Norovirus_and/or_Norovirus-like__AB541211
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaucaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacaccaaguucacccccgucggcgugauccaggacgggagcacgacccaccgcaacgagccccagcagugggugcuccccuccuacagcggccggaacguccacaacgugcaccuggccccggccguggcgcccaccuuccccggggagcagcuccucuucuuccgcuccaccaugcccggcugcagcggcuacccgaacauggaccuggacugccugcucccccaggaguggguccagcacuucuaccaggaggccgcccccgcccaguccgacguggcgcugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcuga

SEQ ID NO: 11619 - RNA, 1617 nt, Artificial Sequence
  derived and/or modified sequence opt1 from VP1__Norovirus_and/or_Norovirus-like__GQ246797
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgcgaaccagaacaccaaguucacccccgucggggugauccaggacggcgacacggcccaccgcaacgagccccagcagugggugcugcccuccuacagcgggcggaacucccacaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcccuccugcgguucgugaaccccgacaccggccgcgugcuguucgagugcaagcuccacaaguccggguacgucacgguggcgcacaccggccagcacgaccuggugaucccgcccaacggguacuuccgguucgacagcugggucaaccaguucuacacccuggcccccaugggcaacgggaccggccgccgccgguga

SEQ ID NO: 11620 - RNA, 1617 nt, Artificial Sequence
  derived and/or modified sequence opt1 from VP1__Norovirus_and/or_Norovirus-like__GQ246794
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccccugguccgcgccgcugggccccgaccugaaccccuaccucagccaccuggcccgcauguacaacggcuacgccgggggcuucgaggugcaggucauccuggccgggaacgccuucacggcgggcaagaucaucuucgccgccgugcccccgaacuuccccaccgaggggcucucccccagccaggugaccauguucccccacaucaucgucgacgugcggcagcuggagccggugcugaucccccuccccgacguccgcaacaacuucuaccacuacaaccaguccaacgaccccaccaucaagcugaucgccaugcuguacacgccgcuccgggccaacaacgcgggcgacgacguguucaccgugagcugccgcguccugacccggcccucccccgacuucgacuucaucuuccuggugcccccgaccguggagagccgcacgaagcccuucuccguccccauccucaccguggaggagaugaccaacagccgguuccccaucccgcuggagaagcuguucaccggccccuccagcgccuucgugguccagccccagaacgggcgcugcacgaccgacggcgugcuccuggggaccacccagcuguccccggucaacaucugcacguuccggggcgacgugacccacaucaccggcagccgcaacuacaccaugaaccucgccacgcagaacuggaacuccuacgaccccaccgaggagauccccgcgccccuggggaccccggacuucgugggcaagauccaggggguccugacccagacgacccgggccgacggcagcacccgcgggcacaaggccaccguguacacgggcagcgccgacuucgcccccaagcucggccgggugcaguucgccaccgacaccgacaacgacuucgacgccaaccagaacaccaaguucacgcccgucggggugauccaggacggcgacaccgcgcaccgcaacgagccccagcagugggugcugccguccuacagcgggcggaacucccacaacguccaccuggcccccgccguggcccccaccuuccccggcgagcagcuccuguucuuccgcagcaccaugccggggugcuccggcuaccccaacauggaccuggacugccuccugccccaggagugggugcaguacuucuaccaggaggcggcccccgcccagagcgacgucgcccugcuccgguucgugaacccggacacgggccgcgugcuguucgagugcaagcugcacaaguccggguacgucaccguggcccacaccggccagcacgaccucgugaucccgcccaacggguacuuccgguucgacagcugggucaaccaguucuacacccuggcgcccaugggcaacgggaccggccgccgccgguga

SEQ ID NO: 11621 - RNA, 1617 nt, Artificial Sequence
  derived and/or modified sequence opt1 from VP1__Norovirus_and/or_Norovirus-like__EU876884
augaagauggccagcaacgacgccaaccccuccgacggcagcaccgcgaaccuggugccggaggucaacuccgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagcgccucuacacgggcccgagcuccgccuucgugguccagccccagaacgggcggugcaccaccgacggcgugcugcuggggaccacgcagcucagcgccgucaacaucugcaccuuccgcggcgacgugacccacaucgccggcucccggaacuacaccaugaaccuggccagccagaacuggaacaacuacgaccccacggaggagaucccggcgccccuggggacccccgacuucgugggcaagauccaggggaugcucacccagaccacgcgcuccgacggcagcacccgggggcacaaggccaccguccugaccggcagcgccgacuucgcccccaagcugggccgcgugcaguucgccacggacaccgacaacgacuucgaguccgggcagaacaccaaguucaccccggugggcgucauccaggacgggagcacgacccaccggaacgagccccagcagugggugcuccccuccuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcgcggggcgccggcgcuga

SEQ ID NO: 11622 - RNA, 1617 nt, Artificial Sequence
  derived and/or modified sequence opt1 from VP1__Norovirus_and/or_Norovirus-like__FJ411170
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggggccuucgugguccagccccagaacggccgcugcaccaccgacggggugcuccugggcaccacgcagcucucccccgucaacaucugcaccuuccggggcgacgugacccacaucgccgggacccacgacuacacgaugaaccuggccagccagaacuggaacaacuacgacccgaccgaggagauccccgcgccccugggcacccccgacuucguggggaagauccagggcguccucacccagacgacccgcggggacggcuccacccggggccacaaggccaccgugagcacgggguccgugcacuucaccccgaagcugggcagcguccaguucaccaccgacacgaacaacgacuucgagaccgggcagaacaccaaguucacccccgugggcgugguccaggacgggaacagcacgcaccagaacgagccccagcagugggugcugcccaacuacuccggccgcaccggccacaacgugcaccucgccccggccgucgcccccaccuuccccggggagcagcugcuguucuuccggagcaccaugcccggcugcuccggguacccgaacaugaaccucgacugccugcugccccaggagugggugcagcacuucuaccaggaggccgcgcccgcccagagcgacguggcccuccugcgcuucgucaaccccgacaccggccgggugcuguucgagugcaagcuccacaaguccggguacgugacggucgcccacaccggccagcacgaccuggugaucccgcccaacggcuacuuccgcuucgacagcugggugaaccaguucuacacccuggcgcccauggggaacggcgccgggcggcgccgguga

SEQ ID NO: 11623 - RNA, 1617 nt, Artificial Sequence
  derived and/or modified sequence opt1 from VP1__Norovirus_and/or_Norovirus-like__EU839589
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguuccgcacggacaccgagaacgacuucgagacccaccagaacaccaaguucacgcccgucggggugauccaggacggcagcaccacccaccggaacgagccccagcagugggugcuccccuccuacagcgggcgcaacguccacaacgugcaccuggccccggccguggcgcccaccuuccccggcgagcagcuccucuucuuccgguccacgaugcccggcugcagcggguacccgaacauggaccuggacugccugcucccccaggaguggguccagcacuucuaccaggaggccgcccccgcccaguccgacguggcgcugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgcuga

SEQ ID NO: 11624 - RNA, 1617 nt, Artificial Sequence
  derived and/or modified sequence opt1 from VP1__Norovirus_and/or_Norovirus-like__KX353961
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccgcaacuacaccaugaaccuggccucccagaacuggaacagcuacgacccgacggaggagauccccgcgccccuggggacccccgacuucgugggcaagauccaggggguccucacccagaccacgcggaccgacggcagcacccgcgggcacaaggccaccguguacacgggcuccgccgacuucagcccgaagcugggccgggugcaguucgccaccgacaccgacaacgacuucgacgccaaccagaacaccaaguucacgcccgucggggugauccaggacggcgacaccgcccaccgcaacgagccccagcagugggugcugcccuccuacagcgggcggaacacccacaacguccaccucgccccggcgguggcccccaccuuccccggcgagcagcugcuguucuuccgcuccacgaugcccgggugcagcggcuacccgaacauggaccucgacugccugcugccccaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 11625 - RNA, 1617 nt, Artificial Sequence
  derived and/or modified sequence opt1 from VP1__Norovirus_and/or_Norovirus-like__AB933757
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccacgccccuggagaagcuguucaccggcccgagcuccaccuucgugguccagccccagaacgggcgcugcaccaccgacggcgugcuccuggggacgacccagcucagccccgucaacaucugcaccuuccggggcgacgugacccacaucacgggcucccacaacuacaccaugaaccuggcgagccagaacuggaacagcuacgacccgaccgaggagauccccgcgccccuggggacccccgacuucgugggcaagauccaggggguccucacgcagaccacccgcaccgacggcuccacgcgggggcacaaggccaccguguacaccggcagcgccgaguucuccccgaagcugggccgcgugcaggucgccaccgacacgaacaacgacuucgacgccaaccagaacaccaaguucacccccgugggggugauccaggacggcgggaccacgcaccggaacgagccccagcaguggguccugcccagcuacuccggccgcaacgcccacaacgugcaccucgccccggccguggcccccaccuuccccggggagcagcugcuguucuuccggagcaccaugcccggcugcuccggcuacccgaacauggaccucgacugccugcugccccaggaguggguccagcacuucuaccaggaggcggcccccgcccagagcgacguggcccuccugcgcuucgugaaccccgacaccgggcggguccuguucgagugcaagcuccacaaguccggcuacgugaccguggcgcacacggggcagcacgaccuggucaucccgcccaacggcuacuuccgcuucgacagcugggugaaccaguucuacacccuggcccccauggggaacggcaccggccggcgccgcuga

SEQ ID NO: 11626 - RNA, 1617 nt, Artificial Sequence
  derived and/or modified sequence opt1 from VP1__Norovirus_and/or_Norovirus-like__KM245074
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcuccucuucuuccgcagcaccaugcccggcugcuccggcuaccccaacauggaccuggacugccugcucccgcaggaguggguccagcacuucuaccaggaggccgcccccgcgcagagcgacguggcccugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcaccggccgccggcgcuga

SEQ ID NO: 11627 - RNA, 1617 nt, Artificial Sequence
  derived and/or modified sequence opt1 from VP1__Norovirus_and/or_Norovirus-like__EU921368
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgcguucgugguccagccccagaacgggcgcugcaccaccgacggcgugcuccuggggaccacgcagcucucccccgucaacaucugcaccuuccggggcaacgugaccaacaucgccggcagccagaccuacacgaugaaccuggccucccagaacuggaacaacuacgacccgaccgaggagauccccgcgccccuggggacccccgacuucgugggcaagauccaggggguccucacccagacgaccaagggcgacgggagcacccgcggccacaaggccaccgugagcacgggcuccgcccaguucaccccgaagcuggggagcgugcaguucuccaccgacaccagcacggacuucgagaccggccagaacacccgguucacccccgucggggugauccaggacggcuccacgacccacaagaacgagccccagcagugggugcugcccagcuacuccgggcgcgacagccacaacguccaccucgccccggccguggcccccaccuuccccggcgagcagauccuguucuuccgguccaccaugcccggcugcagcggguacccgaacauggaccuggacugccuccugccccaggagugggugcagcacuucuaccaggaguccgcccccgcgcagagcgacgucgcccugcuccgcuucgugaaccccgacaccggccgggugcuguucgagugcaagcugcacaaguccggguacgucacgguggcccacaccggccagcacgaccucgugaucccgcccaacggguacuuccgcuucgacagcugggucaaccaguucuacacccuggcccccaugggcaacggcgcggggcggcgccgguga

SEQ ID NO: 11628 - RNA, 1617 nt, Artificial Sequence
  derived and/or modified sequence opt1 from VP1__Norovirus_and/or_Norovirus-like__EU921338
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccguguccacgggcagcgugcacuucaccccgaagcuggggagcguccaguucuccaccgacaccagcaacgacuucgagacgggccagaacacccgcuucacccccgugggggugguccaggacggcuccaccacgcaccagaacgagccccagcagugggugcugcccgccuacagcgggcgggacaaccacaacgugcaccucgccccggccgucgcccccaccuuccccggcgagcagcugcuguucuuccgcuccaccaugcccggcugcagcggguacccgaacaugaaccucgacugccugcugccccaggagugggugcagcacuucuaccaggaguccgcgcccgcccagagcgacguggcccuccugcgguucgucaaccccgacaccggccgcgugcuguucgagugcaagcuccacaaguccggguacgugaccgucgcccacacgggccagcacgaccuggugaucccgcccaacggguacuuccgguucgacagcugggugaaccaguucuacacccuggcgcccaugggcaacggcgccgggcgccggcgcuga

SEQ ID NO: 11629 - RNA, 1617 nt, Artificial Sequence
  derived and/or modified sequence opt1 from VP1__Norovirus_and/or_Norovirus-like__LC005708
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacguccagaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11630 - RNA, 1617 nt, Artificial Sequence
  derived and/or modified sequence opt1 from VP1__Norovirus_and/or_Norovirus-like__LC005704
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcuga

SEQ ID NO: 11631 - RNA, 1617 nt, Artificial Sequence
  derived and/or modified sequence opt1 from VP1__Norovirus_and/or_Norovirus-like__KF429777
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggagcaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcugggguccgugcaguucgccacggacaccgagaacgacuucgagacccaccagaacacccgcuucacgccggucggcgugauccaggacgggggcaccacccaccggaacgagccccagcagugggugcuccccagcuacuccgggcgcaacguccacaacgugcaccuggcccccgcgguggccccgaacuuccccggcgagcagcuccucuucuuccggagcaccaugcccggcugcuccggguaccccaacauggaccuggacugccugcucccgcaggaguggguccagcacuucuaccaggaggccgcccccgcgcagagcgacguggcccugcugcgcuucgugaaccccgacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgcuga

SEQ ID NO: 11632 - RNA, 1617 nt, Artificial Sequence
  derived and/or modified sequence opt1 from VP1__Norovirus_and/or_Norovirus-like__JX439840
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcauccccgacuucguggggaagauccagggcguccugacgcagaccaccaagggggacggcuccacccggggccacaaggccacgguguacaccgggagcgcccccuucaccccgaagcugggcagcgugcaguucuccaccgacacggagaacgacuucgagacccaccagaacaccaaguucacccccgucggggugauccaggacggcgggacgacccaccgcaacgagccccagcagugggugcuccccagcuacuccggccggaacguccagaacgugcaccuggccccggccguggcgcccaccuuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggaccggccgccggcgcuga

SEQ ID NO: 11633 - RNA, 1617 nt, Artificial Sequence
  derived and/or modified sequence opt1 from VP1__Norovirus_and/or_Norovirus-like__JX644026
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgcccagaacguccaccuggccccggcgguggcccccaccuuccccggggagcagcuccucuucuuccgcuccacgaugcccggcugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcuga

SEQ ID NO: 11634 - RNA, 1617 nt, Artificial Sequence
  derived and/or modified sequence opt1 from VP1__Norovirus_and/or_Norovirus-like__JX459906
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucggcacggacaccgagaacgacuucgagacccaccagaacaccaaguucacgcccgucggggugauccaggacggcgggaccacccaccgcaacgagccccagcagugggugcuccccuccuacagcggccgggacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11635 - RNA, 1617 nt, Artificial Sequence
  derived and/or modified sequence opt1 from VP1__Norovirus_and/or_Norovirus-like__JX459597
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugccacgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgccuucgugguccagccccagaacgggcgcugcaccaccgacggcgugcugcuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggccgcauccaggggguccucacccagacgacccggcgcgacggcuccacccgggggcacaaggccacccugagcacgggcuccgugcacuucaccccgaagcugggcagcgugcaguucagcaccgacaccuccaacgacuucgagacggggcagaacacccgcuucacccccgucggcguggugcaggacgggagcaccacgcaccagaacgagccccagcaguggguccuccccaacuacuccggccgggacagccacaacgugcaccuggccccggccguggcccccaccuuccccggggagcagcuccucuucuuccgcuccaccaugcccggcugcagcggcuacccgaacaugaaccuggacugccugcucccccaggaguggguccagcacuucuaccaggaguccgcccccgcgcagagcgacguggcccugcugcgguucgugaaccccgacaccgggcgcguccucuucgagugcaagcugcacaaguccggcuacgugaccguggcccacacggggcagcacgaccuggucaucccgcccaacggcuacuuccgguucgacagcugggugaaccaguucuacacccucgcccccauggggaacggcgcgggccgccgccgguga

SEQ ID NO: 11636 - RNA, 1617 nt, Artificial Sequence
  derived and/or modified sequence opt1 from VP1__Norovirus_and/or_Norovirus-like__HQ456334
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucaacacggacaccgagaacgacuucgagacccaccagaacaccaaguucacgccggucggcgugauccaggacgggagcaccacccaccgcaacgagccccagcagugggugcuccccuccuacagcggccggaacguccacaacgugcaccuggcccccgccguggccccgaccuuccccggggagcagcuccucuucuuccgcuccacgaugcccggcugcagcggcuaccccaacauggaccuggacugccugcucccgcaggaguggguccagcacuucuaccaggaggccgcgcccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11637 - RNA, 1617 nt, Artificial Sequence
  derived and/or modified sequence opt1 from VP1__Norovirus_and/or_Norovirus-like__HM802553
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagguccuccuggccgggaacgccuucaccgccggcaagaucaucuucgccgccgugccgcccacguucccgaccgaggggcugucccccagccaggugaccauguucccccacaucaucgucgacgugcggcagcucgagcccgugcugaucccgcugcccgacguccgcaacaacuucuaccacuacaaccaguccaacgacagcaccaucaagcucguggccaugcuguacacgccccugcgggcgaacaacgccggcgacgacguguucaccgucuccugccgcgugcucacccggcccagcccggacuucgacuucaucuuccuggugccgcccaccgucgagucccgcacgaagcccuucaccgugcccauccugaccguggaggagaugaccaacagccgguuccccaucccccucgagcgccuguucacgggccccuccagcgccuucgucgugcagccgcagaacgggcggugcaccaccgacggcguccugcucgggaccacgcagcugucccccgugaacaucugcaccuuccgcggcgacgugaccaacauccccggcagccggaccuaccgcaugaaccuggccucccagaacuggaacaacuacgacccgacggaggagauccccgcgccccucgggacccccgacuucgucggcaagauccagggggugcugacccagaccacgaagggcgacgggagcacccggggccacaaggccaccgugcgcaccggcagcgccgacuucacgccgaagcugggguccguccaguucgccaccgacaccgacaacgacuucgugaccggccagaacacgcgguucacccccgugggggucauccacgacggcagcuccgcccaccgcaacgagccccagcagugggugcuccccgaguacagcgggcgguccgugcacaacguccaccuggccccggcgguggcccccaccuuccccggcgagcagcuccucuucuuccgcagcaccaugcccggcugcuccggguacccgaacauggaccuggacugccugcucccccaggagugggugcagcacuucuaccaggaggccgcccccagccaguccgacgucgcgcugcugcgguucgugaaccccgacacgggccgcgugcuguucgagugcaagcugcacaaggccggguacgucaccguggcccacaccggccagcacgaccuggugaucccgcccaacggguacuuccgcuucgacagcugggucaaccaguucuacacccucgcccccaugggcaacggcgccgggcggcgccgguga

SEQ ID NO: 11638 - RNA, 1617 nt, Artificial Sequence
  derived and/or modified sequence opt1 from VP1__Norovirus_and/or_Norovirus-like__HQ008055
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgacgacguguucaccguguccugccgcguccucacccggccgagccccgacuucgacuucaucuuccuggugccgcccaccguggagucccgcacgaagcccuucagcguccccauccugaccguggaggagaugaccaacucccgguuccccaucccccucgagaagcuguucaccggcccgagcuccgccuucgugguccagccccagaacgggcgcugcacgaccgacggcgugcugcucgggaccacccagcugagccccgucaacaucugcacguuccggggcgacgugacccacaucaccggcucccacaacuacaccaugaaccuggccagccagaacuggaacuccuacgacccgacggaggagauccccgcgccccucgggacccccgacuucgugggcaagauccaggggguccugacccagaccacgcgcgccgacggcagcacccgggggcaccgcgccaccguguacaccggcagcgccgaguucgccccgaagcugggccgggugcaguucgccacggacaccgagaacgacuucgacaccaaccagaacaccaaguucacgcccgucggggugauccaggacggcaacaccacccaccgcaacgagccccagcagugggugcuccccuccuacagcgggcggaacucccacaacguccaccuggccccggcgguggcccccaccuuccccggcgagcagcuccuguucuuccgcagcacgaugcccgggugcuccggcuacccgaaccuggaccuggacugccuccugccccaggagugggugcagcacuucuaccaggaggccgcccccgcgcagagcgacgucgcccugcuccgguucgugaaccccgacaccggccgcgugcuguucgagugcaagcugcacaaguccggguacgucaccguggcccacaccggccagcacgaccucgugaucccgcccaacggguacuuccgguucgacagcugggucaaccaguucuacacccuggcccccaugggcaacgggacgggccgccgccgguga

SEQ ID NO: 11639 - RNA, 1617 nt, Artificial Sequence
  derived and/or modified sequence opt1 from VP1__Norovirus_and/or_Norovirus-like__AB541360
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagauccaccagaacaccaaguucacccccgucggcgugauccaggacgggagcacgacccaccgcaacgagccccagcagugggugcuccccuccuacagcggccggaacguccacaacgugcaccuggccccggccguggcgcccaccuuccccggggagcagcuccucuucuuccgcuccaccaugcccggcugcagcggcuacccgaacauggaccuggacugccugcucccccaggaguggguccagcacuucuaccaggaggccgcccccgcccaguccgacguggcgcugcugcgguucgugaaccccgacacggggcgcguccucuucgagugcaagcugcacaagagcggcuacgugaccguggccuacaccgggcagcacgaccuggucaucccgcccaacggcuacuuccgguucgacuccugggugaaccaguucuacacccucgcccccauggggaacggcaccggccgccggcgcuga

SEQ ID NO: 11640 - RNA, 1617 nt, Artificial Sequence
  derived and/or modified sequence opt1 from VP1__Norovirus_and/or_Norovirus-like__AB541262
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacguggccggcucccgcaacuacaucaugaaccuggccagccugaacuggaacaacuacgaccccaccgaggagaucccggcgccccucgggacccccgacuucgucggcaagauccagggggugcugacgcagaccaccaagggcgacggguccacccggggccacaaggccacgguguacaccggcagcgcccccuucaccccgaagcuggggagcguccaguucuccaccgacacggagaacgacuucgagacccaccagaacaccaaguucacccccgugggcgugauccaggacgggagcacgacccaccgcaacgagccccagcaguggguccuccccuccuacagcggccggaacgugcacaacgugcaccuggccccggccgucgcgcccaccuuccccggggagcagcuccucuucuuccgcuccaccaugcccggcugcagcggcuacccgaacauggaccuggacugccugcucccccaggagugggugcagcacuucuaccaggaggccgcccccgcccaguccgacguggcgcugcugcgguucgucaaccccgacacggggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcaccggccgccggcgcuga

SEQ ID NO: 11641 - RNA, 1617 nt, Artificial Sequence
  derived and/or modified sequence opt1 from VP1__Norovirus_and/or_Norovirus-like__AB541231
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgccgugcagccgcagaacgggcgcugcacgaccgacggcguccugcuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcccccaccuuccccggggagcagcuccucuucuuccgcuccacgaugccgggcugcagcggcuaccccaacauggaccuggacugccugcucccccaggagugggugcagcacuucuaccaggaggccgcccccgcgcaguccgacgucgcccugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcuga

SEQ ID NO: 11642 - RNA, 1617 nt, Artificial Sequence
  derived and/or modified sequence opt1 from VP1__Norovirus_and/or_Norovirus-like__GQ246792
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucaccccgaagcugggccgggugcaguucgccaccgacaccgacaacgacuucgacgccaaccagaacacgaaguucacccccgucggggugauccaggacggcaacaccgcccaccgcaacgagccccagcagugggugcugcccuccuacagcgggcggaacucccacaacguccaccucgcgccggccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 11643 - RNA, 1617 nt, Artificial Sequence
  derived and/or modified sequence opt1 from VP1__Norovirus_and/or_Norovirus-like__AB504329
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11644 - RNA, 1617 nt, Artificial Sequence
  derived and/or modified sequence opt1 from VP1__Norovirus_and/or_Norovirus-like__AB504306
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaagagccgguuccccaucccccuggagaagcucuacaccggccccuccagcgccuucgugguccagccgcagaacgggcgcugcacgaccgacggcgugcugcuggggaccacccagcucuccgucgugaacaucugcacguuccggggcgacgugacccacaucgccggcagccacgacuacaccaugaaccuggccucccagaacuggaacaacuacgaccccaccgaggagauccccgccccgcuggggacgcccgacuucgucggcaagauccaggggaugcucacccagaccacccgcgaggacggcagcacgcgggcgcacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcgcaccggccacaacgugcaccucgcccccgccguggcccccaccuucccgggggagcagcugcuguucuuccggagcacgaugcccggcugcuccggcuaccccaacaugaaccucgacugccugcugccccaggaguggguccagcacuucuaccaggaggcggccccggcccagagcgacguggcccuccugcgcuucgugaaccccgacaccgggcgguuccuguucgagugcaagcuccacaaguccggcuacgucaccguggcgcacaccgggccccacgaccuggugaucccgcccaacggcuacuuccgcuucgacagcugggucaaccaguucuacacccuggcccccauggggaacggcgccggccggcgccggguguga

SEQ ID NO: 11645 - RNA, 1617 nt, Artificial Sequence
  derived and/or modified sequence opt1 from VP1__Norovirus_and/or_Norovirus-like__GQ303445
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgaccacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgguga

SEQ ID NO: 11646 - RNA, 1617 nt, Artificial Sequence
  derived and/or modified sequence opt1 from VP1__Norovirus_and/or_Norovirus-like__EU839588
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccuggccguggaggagaugaccaacucccgguuccccaucccccuggagaagcuguucaccggccccagcuccgcccucgugguccagccgcagaacgggcgcugcaccacggacggcgugcugcucgggaccacccagcugagccccgucaacaucugcaccuuccggggcgacgugacgcacaucgccggcucccgcaacuacaccaugaaccuggcgagccucaacuggaacaacuacgaccccaccgaggagaucccggcgccccuggggacccccgacuucgugggcaagauccaggggguccugacgcagaccaccaagggcgacggguccacccggggccacaaggccacgguguacaccggcagcgcccccuucaccccgaagcucgggagcgugcaguucggcaccgacacggagaacgacuucgagacccaccagaacaccaaguucacccccgucggggugauccaggacggcuccacgacccaccgcaacgagccccagcagugggugcugcccagcuacuccgggcggaacguccacaacgugcaccuggccccggccguggcccccaccuuccccggcgagcagcuccuguucuuccgcagcaccaugcccggcugcuccggguacccgaacauggaccuggacugccuccugccccaggaguggguccagcacuucuaccaggaggccgcccccgcgcagagcgacguggcccugcuccgguucgugaaccccgacacgggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcaccgggcgccggcgcuga

SEQ ID NO: 11647 - RNA, 1617 nt, Artificial Sequence
  derived and/or modified sequence opt1 from VP1__Norovirus_and/or_Norovirus-like__DQ364459
augaagauggccagcaacgacgccuccagcuccgacggcagcaccgcgaaccuggugcccgaggucaacaacgaggugauggcccucgagccgguggucggggccgccaucgccgcgcccguggccggccagcagaacgugaucgaccccuggauccgcaacaacuucguccaggcccccgggggcgaguucaccguguccccgcggaacgcccccggggagauccuguggagcgcgccccugggccccgaccucaacccguaccugucccaccuggcccgcauguacaacggcuacgccgggggcuucgaggugcaggucauccucgccgggaacgccuucacggcgggcaagaucaucuucgccgccgugccgcccaacuuccccaccgaggggcugagccccucccaggugaccauguucccccacaucaucgucgacgugcggcagcuggagcccgugcucaucccccugccggacguccgcaacaacuucuaccacuacaaccagagcaacgaccccaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccacgacuacacgaugaaccuggccagccagaacuggaacaacuacgaccccaccgaggagaucccggcgccccuggggacccccgacuucgugggcaagauccaggggguccucacccagacgacccgcggcgacggguccacccggggccacaaggccaccgugagcacgggcagcgugcacuucacccccaagcugggguccguccaguucaccaccgacacgaacaacgacuucgagaccggccagaacaccaaguucaccccggugggggugguccaggacggcaacagcacgcaccagaacgagccccagcagugggugcugcccaacuacuccgggcgcaccggccacaacgugcaccucgcccccgccgucgccccgaccuuccccggcgagcagcugcuguucuuccggagcaccaugcccgggugcuccggcuaccccaacaugaaccucgacugccugcugccgcaggagugggugcagcacuucuaccaggaggccgcgcccgcccagagcgacguggcccuccugcgcuucgucaaccccgacaccgggcgggugcuguucgagugcaagcuccacaaguccggcuacgugacggucgcccacaccgggcagcacgaccuggugaucccgcccaacggcuacuuccgcuucgacagcugggugaaccaguucuacacccuggcgcccaugggcaacggggccggccggcgccgguga

SEQ ID NO: 11648 - RNA, 1617 nt, Artificial Sequence
  derived and/or modified sequence opt1 from VP1__Norovirus_and/or_Norovirus-like__KY628449
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugagcccggaccucaaccccuaccugucccaccuggcccgcauguacaacggcuacgccggcggguucgaggugcaggucauccucgccggcaacgccuucaccgccgggaaggugaucuucgccgccgugccgcccaacuucccgacggagggccugagccccucccaggucaccauguucccccacaucgugguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggggacgacgucuucaccgugagcugccgcgugcugacccggcccuccccggacuucgacuucaucuuccucgucccgcccaccguggagagccgcaccaagcccuucuccgugcccguccugacgguggaggagaugaccaacagccgguuccccaucccccuggagaagcuguucaccggccccuccagcgacuucgccguccagccgcagaacggccgcugcaccacggacggggugcugcugggcaccacccagcucucccccgugaacaucugcaccuuccgcggggacgucacgcacaucaacggcagcagcaacuacaagaugaaccuggccaaccagaacugguccaacuacgaccccaccgaggagaucccggcgccccugggcgcccccgacuucguggggaagauccagggcgugcucacccagaccacgaaggaggacgggagcacccggggccacaaggccaccgucuacaccggguccgccgacuucgcccccaagcugggccgggugcaguucgagacggacaccgaccacgaccuggagaucgaccagaacaccaaguucaccccggugggcgucauccagaacgggggcacgacccaccgcaacgagcccaagcaguggaugcuccccagcuacuccgggcggaacacccccaacgugcaccuggccccggcgguggcccccaccuuccccggcgagcagcuccucuucuuccgcagcacgaugcccgggugcuccggcuacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacagcggccagcacgaccuggucgugccgcccaacggguacuuccgguucgacuccugggugaaccaguucuacacccucgcccccaugggcaacgggagcggccgccggcgcuga

SEQ ID NO: 11649 - RNA, 1617 nt, Artificial Sequence
  derived and/or modified sequence opt1 from VP1__Norovirus_and/or_Norovirus-like__KX371608
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccacaacuacaccaugaaccuggccucccugaacuggaacaacuacgaccccaccgaggagaucccggcgccccucgggacgcccgacuucgugggcaagauccaggggguccugacccagaucaccaagggcgacgggagcacccgcggccacaaggccacgguguacaccggcagcgccgacuucacccccaagcugggguccgugcaguucgccaccgacacggagaacgacuuccagacccaccagaacacccgguucaccccggucggcgugauccaggacgggggcacgacccaccagaacgagccccagcagugggugcuccccagcuacuccgggcgcaacguccacaacgugcaccuggcccccgcgguggccccgaacuuccccggcgagcagcuccucuucuuccggagcaccaugcccggcugcuccggguaccccaacauggaccuggacugccugcucccgcaggaguggguccagcacuucuaccaggaggccgcccccgcgcagagcgacguggcccugcugcgcuucgugaaccccgacaccggccggguccucuucgagugcaagcugcacaaguccggguacgugacgguggcccacaccggccagcacgaccuggucaucccgcccaacggguacuuccgcuucgacagcugggugaaccaguucuacacccucgcccccaugggcaacggcaccgggcggcgccgguga

SEQ ID NO: 11650 - RNA, 1617 nt, Artificial Sequence
  derived and/or modified sequence opt1 from VP1__Norovirus_and/or_Norovirus-like__KX354089
augaagauggccagcaacgacgccaaccccuccgacggcagcgcggccucccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgccgacuucacccccaagcugggguccgugcaguucgccacggacaccgagaacgacuucgagacccaccagaacaccaaguucacgccggucggcgugauccaggacgggggcaccacccaccgcaacgagccccagcagugggugcuccccagcuacuccgggcggaacguccacaacgugcaccuggcccccgcgguggccccgaacuuccccggcgagcagcuccucuucuuccgcagcaccaugcccggcugcuccggguaccccaacauggaccuggacugccugcucccgcaggaguggguccagcacuucuaccaggaggccgcccccgcgcagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11651 - RNA, 1617 nt, Artificial Sequence
  derived and/or modified sequence opt1 from VP1__Norovirus_and/or_Norovirus-like__KX354001
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucaucgugcagccgcagaacgggcgcugcacgaccgacggcguccugcuggggaccacccagcucucccccgugaacaucugcacguuccggggcgacgucacccacaucgccggcagccgcaacuacaccaugaaccuggccucccugaacuggaacaacuacgaccccaccgaggagaucccggcgccccucgggacgcccgacuucgugggcaagauccagggggugcugacccagaccaccaagggcgacgggagcacgcggggccacaaggccaccgucuacaccggcagcgccgacuucacccccaagcugggguccgugcaguucgccacggacaccgagaacgacuucgagacccaccagaacacccgcuucacgccggugggcgucauccaggacgggggcaccacccaccggaacgagccccagcagugggugcuccccagcuacuccgggcgcaacgugcacaacguccaccuggcccccgcgguggccccgaacuuccccggcgagcagcuccucuucuuccggagcaccaugcccggcugcuccggguaccccaacauggaccuggacugccugcucccgcaggagugggugcagcacuucuaccaggaggccgcccccgcgcagagcgacgucgcccugcugcgcuucgugaaccccgacacgggccggguccucuucgagugcaagcugcacaaguccggguacgugaccguggcccacaccggccagcacgaccuggugaucccgcccaacggguacuuccgcuucgacagcugggucaaccaguucuacacccucgcccccaugggcaacggcaccgggcggcgccgcuga

SEQ ID NO: 11652 - RNA, 1617 nt, Artificial Sequence
  derived and/or modified sequence opt1 from VP1__Norovirus_and/or_Norovirus-like__KX353971
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccucccagaacuggaacagcuacgacccgacggaggagauccccgcgccccuggggacccccgacuucgucggcaagauccagggggugcucacccagaccacgcggaccgacggcagcacccgcgggcacaaggccaccguguacacgggcuccgccgacuucagcccgaagcugggccggguccaguucgccaccgacaccgacaacgacuucgagaccaaccagaacacgaaguucacccccgugggggugauccaggacggcgggaccacccaccgcaacgagccccagcaguggguccugcccuccuacagcggccggaacacgcacaacgugcaccucgccccggccguggcccccaccuuccccggggagcagcugcuguucuuccgcuccaccaugcccggcugcagcggcuacccgaacauggaccucgacugccugcugccccaggaguggguccaguacuucuaccaggaggcggcccccgcccaguccgacguggcccuccugcgguucgugaaccccgacaccgggcgcguccuguucgagugcaagcuccacaagagcggcuacgugaccguggcgcacacggggcagcacgaccuggucaucccgcccaacggcuacuuccgguucgacuccugggugaaccaguucuacacccuggcccccauggggaacggcaccggccgccgccgguga

SEQ ID NO: 11653 - RNA, 1617 nt, Artificial Sequence
  derived and/or modified sequence opt1 from VP1__Norovirus_and/or_Norovirus-like__KR131766
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagcgccucuacacgggccccagcuccgccuucgugguccagccgcagaacgggcggugcaccaccgacggcgugcugcuggggaccacgcagcucagcgccgucaacaucugcaccuuccgcggcgacgugacccacaucgccggcucccggaacuacaccaugaaccuggccagccagaacuggaacaacuacgaccccacggaggagauccccgcgccgcuggggacccccgacuucgugggcaagauccaggggaugcucacccagaccacgcgcuccgacggcagcacccgggggcacaaggccaccguccugaccggcagcgccgacuucgcccccaagcugggccgcgugcaguucgccacggacaccgacaacgacuucgaguccgggcagaacaccaaguucacccccgugggcgucauccaggacgggagcacgacccaccggaacgagccgcagcagugggugcuccccaacuacuccggccgcaccgggcacaacgugcaccuggcgcccgccgucgcccccaccuacccgggcgagcagcuccucuucuuccggagcacgaugcccggcugcuccggguaccccaacauggaccuggacugccugcucccccaggagugggugcagcacuucuaccaggaggccgcgccggcccagagcgacguggcccugcugcgcuucgucaaccccgacaccggccgggugcuguucgagugcaagcugcacaaguccggguacgugaccgucgcccacaccggccagcacgaccuggugaucccgcccaacggguacuuccgcuucgacagcugggugaaccaguucuacacccucgcccccaugggcaacggcacggggcgccggcgcuga

SEQ ID NO: 11654 - RNA, 1617 nt, Artificial Sequence
  derived and/or modified sequence opt1 from VP1__Norovirus_and/or_Norovirus-like__AB663685
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcgccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugaaccuggcgagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgccgacuucacccccaagcuggggagcgugcaguucggcaccgacacggagaacgacuucgagacccaccagaacaccaaguucaccccggucggggugauccaggacggcgggacgacccaccgcaacgagccccagcagugggugcuccccuccuacagcggccggaacguccacaacgugcaccuggcccccgccguggccccgaacuuccccggcgagcagcuccucuucuuccgcuccaccaugcccgggugcagcggcuaccccaacauggaccuggacugccugcucccgcaggaguggguccagcacuucuaccaggaggccgcccccgcgcaguccgacguggcccugcugcgguucgugaaccccgacaccgggcgcguccucuucgagugcaagcugcacaagagcggcuacgugacgguggcccacaccgggcagcacgaccuggucaucccgcccaacggcuacuuccgguucgacuccugggugaaccaguucuacacccucgcccccaugggcaacgggaccggccgccggcgcuga

SEQ ID NO: 11655 - RNA, 1617 nt, Artificial Sequence
  derived and/or modified sequence opt1 from VP1__Norovirus_and/or_Norovirus-like__AB933746
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucgccggcagccacaacuacaccaugaaccuggccucccagaacuggaacagcuacgacccgaccgaggagauccccgcgccccuggggacgcccgacuucgucggcaagauccagggggugcucacccagaccacccgcacggacggcagcacccgggggcacaaggccaccguguacaccggcuccgccgaguucagcccgaagcugggccgcguccaguucgccacggacaccaacaacgacuucgacgccaaccagaacaccaaguucacccccgugggggugauccaggacggcgggacgacccaccggaacgagccccagcaguggguccugcccuccuacagcggccgcaacacccacaacgugcaccucgccccggcgguggcccccaccuuccccggggagcagcugcuguucuuccgguccacgaugcccggcugcagcggcuacccgaacauggaccucgacugccugcugccccaggaguggguccaguacuucuaccaggaggccgcccccgcgcaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcccccauggggaacggcacgggccggcgccgcuga

SEQ ID NO: 11656 - RNA, 1617 nt, Artificial Sequence
  derived and/or modified sequence opt1 from VP1__Norovirus_and/or_Norovirus-like__AB933701
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugagccuggccucccugaacuggaacaacuacgaccccaccgaggagaucccggcgccccucgggacccccgacuucgugggcaagauccaggggguccugacgcagaccaccaagggcgacgggagcacccggggccacaaggccacgguguacaccggcagcgcccccuucaccccgaagcugggguccgugcaguucagcaccgacacggagaacgacuucgagacccaccagaacaccaaguucacccccgucggcgugauccaggacgggggcacgacccaccgcaacgagccccagcagugggugcuccccuccuacagcgggcggaacgucccgaacgugcaccuggcccccgccguggcgcccaccuuccccggcgagcagcuccucuucuuccgcuccaccaugccgggcugcagcggguaccccaacauggaccuggacugccugcucccccaggaguggguccagcacuucuaccaggaggccgcccccgcccaguccgacguggcgcugcugcgguucgugaacccggacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcuga

SEQ ID NO: 11657 - RNA, 1617 nt, Artificial Sequence
  derived and/or modified sequence opt1 from VP1__Norovirus_and/or_Norovirus-like__AB933686
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacaccaaguucacccccgucggcgugauccaggacgggggcacgacccaccgcaacgagccccagcagugggugcuccccagcuacuccgggcggaacgucccgaacgugcaccuggcccccgccguggcgcccaccuuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11658 - RNA, 1617 nt, Artificial Sequence
  derived and/or modified sequence opt1 from VP1__Norovirus_and/or_Norovirus-like__AB933680
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccgcccaccgcaacgagccccagcagugggugcuccccuccuacagcggccggaacguccagaacgugcaccuggccccggcgguggcccccaccuuccccggggagcagcuccucuucuuccgcuccaccaugcccggcugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcuga

SEQ ID NO: 11659 - RNA, 1617 nt, Artificial Sequence
  derived and/or modified sequence opt1 from VP1__Norovirus_and/or_Norovirus-like__AB933672
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccacaacuacaccaugaaccuggccagccugaacuggaacaacuacgaccccaccgaggagaucccggcgccccucgggacgcccgacuucgugggcaagauccaggggguccugacccagaccaccaagggcgacggguccacgcgcggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccgcccaccggaacgagccccagcagugggugcuccccagcuacuccgggcgcaacguccagaacgugcaccuggccccggcgguggcccccaccuuccccggcgagcagcuccucuucuuccggagcaccaugcccggcugcuccggguacccgaacauggaccuggacugccugcucccccaggaguggguccagcacuucuaccaggaggccgcccccgcgcagagcgacguggcccugcugcgcuucgugaaccccgacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgguga

SEQ ID NO: 11660 - RNA, 1617 nt, Artificial Sequence
  derived and/or modified sequence opt1 from VP1__Norovirus_and/or_Norovirus-like__AB933664
augaagauggccagcaacgacgccacccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucaacaccgacaccgagaacgacuucgagacccaccagaacacgaaguucacccccgucggcgugauccaggacggguccaccacccaccgcaacgagccccagcagugggugcuccccagcuacuccggccggaacgucccgaacgugcaccuggcccccgccguggcgcccacguuccccggggagcagcuccucuucuuccgcagcaccaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccauggggaacggcaccggccgccggcgcuga

SEQ ID NO: 11661 - RNA, 1617 nt, Artificial Sequence
  derived and/or modified sequence opt1 from VP1__Norovirus_and/or_Norovirus-like__AB933662
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaucuuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11662 - RNA, 1617 nt, Artificial Sequence
  derived and/or modified sequence opt1 from VP1__Norovirus_and/or_Norovirus-like__AB933656
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11663 - RNA, 1617 nt, Artificial Sequence
  derived and/or modified sequence opt1 from VP1__Norovirus_and/or_Norovirus-like__EU921340
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcgccgggacggcuccacccgcgggcacaaggccaccgugagcaccggcagcgugcacuucacgccgaagcugggccggauccaguucuccaccgacaccagcaacgacuucgagaccgggcagaacacgcgcuucacccccgucggcguggugcaggacggguccaccacccaccagaacgagccccagcaguggguccugcccgacuacagcggccgggacucccacaacgugcaccucgccccggccguggcccccagcuuccccggggagcagcugcuguucuuccgcuccacgaugcccggcugcagcggcuacccgaacaugaaccucgacugccugcugccccaggaguggguccagcacuucuaccaggaggccgcgcccgcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgguga

SEQ ID NO: 11664 - RNA, 1617 nt, Artificial Sequence
  derived and/or modified sequence opt1 from VP1__Norovirus_and/or_Norovirus-like__KC962453
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccaucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaaggugaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccauccccgugcugaccaucgaggagaugaccaacagccgguuccccaucccccuggagaagcuguucaccggcccguccagcgccuucgugguccagccccagaacgggcgcugcuccacggacggcgugcugcuggggaccacccagcucagccccgucaacaucugcaccuuccggggcgacgugacgcacaucgccggcucccacaacuacaccaugaaccuggccagccagaacuggaacagcuacgacccgaccgaggagauccccgcgccccuggggacccccgacuucgugggcaagauccaggggguccucacgcagaccacccgcgccgacggcuccacccgggggcacaaggccacggugcugaccggcagcgccaacuucaccccgaagcugggccgcauccaguucgccaccgacacggacaacgacuucgagaccaaccagaacaccaaguucacccccgugggggucauccaggacggcgacacggcccaccggaacgagccccagcagugggugcuccccuccuacagcgggcgcaacacccacaacgugcaccuggcgccggccgucgcccccaccuuccccggcgagcagcuccucuucuuccgguccaccauccccgggugcagcggcuacccgaacauggaccuggacugccugcucccccaggagugggugcaguucuucuaccaggaggccgcgcccgcccaguccgacguggcccugcugcgcuucgucaaccccgacacgggccggguccucuucgagugcaagcugcacaagagcggguacaucaccguggcccacaccggccagcacgaccuggugaucccgcccaacggguacuuccgcuucgacuccugggugaaccaguucuacacccucgcccccaugggcaacgggaccggccggcgccgcuga

SEQ ID NO: 11665 - RNA, 1617 nt, Artificial Sequence
  derived and/or modified sequence opt1 from VP1__Norovirus_and/or_Norovirus-like__KF712501
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucaccggcagccgcaacuacaccaugaaccuggccucccagaacuggaacagcuacgaccccacggaggagaucccggcgccccuggggacccccgacuucgugggcaagauccaggggguccucacccagaccacgcggaccgacggcagcacccgcgggcacaaggccaccguguacacgggcuccgccgacuucagccccaagcugggccgggugcaguucgccaccgacaccgacaacgacuucgacaccaaccagaacacgaaguucaccccggucggggugauccaggacggcgggaccacccaccgcaacgagccccagcagugggugcugcccuccuacagcggccggaacacgcacaacguccaccucgcccccgccguggccccgaccuuccccggggagcagcugcuguucuuccgcuccaccaugcccggcagcuccggcuaccccaacauggaccucgacugccugcugccgcaggagugggugcaguacuucuaccaggaggcggcccccgcccagagcgacgucgcccuccugcgguucgugaaccccgacaccgggcgcgugcuguucgagugcaagcuccacaaguccggcuacgucaccguggcgcacacggggcagcacgaccuggugaucccgcccaacggcuacuuccgguucgacagcugggucaaccaguucuacacccuggcccccauggggaacggcaccggccgccgccgguga

SEQ ID NO: 11666 - RNA, 1617 nt, Artificial Sequence
  derived and/or modified sequence opt1 from VP1__Norovirus_and/or_Norovirus-like__JX459903
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgaccacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccgaccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 11667 - RNA, 1617 nt, Artificial Sequence
  derived and/or modified sequence opt1 from VP1__Norovirus_and/or_Norovirus-like__JX459629
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11668 - RNA, 1617 nt, Artificial Sequence
  derived and/or modified sequence opt1 from VP1__Norovirus_and/or_Norovirus-like__JX445165
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccacguucgugguccagccccagaacgggcgcugcaccaccgacggcgugcuccuggggaccacgcagcucagccccgucaacaucugcaccuuccggggcgacgugacccacaucaccggcucccgcaacuacacgaugaaccuggcgagccagaacuggaacagcuacgacccgaccgaggagauccccgcgccccuggggacccccgacuucgugggcaagauccaggggguccucacccagacgacccggaccgacggcuccacccgcgggcacaaggccacgguguacaccggcagcgccgaguucuccccgaagcugggccgggugcaguucgccaccgacaccgacaacgacuucgacgccaaccagaacacgaaguucacccccgucggggugauccaggacggcgggaccacccaccgcaacgagccccagcagugggugcugcccagcuacuccggccggaacacgcacaacguccaccucgccccggccguggcccccaccuuccccggggagcagcugcuguucuuccgcagcaccaugcccggcugcuccggcuacccgaacauggaccucgacugccugcugccccaggagugggugcagcacuucuaccaggaggccgcgcccgcccagagcgacgucgcccuccugcgguucgugaaccccgacaccgggcgcgugcuguucgagugcaagcuccacaaguccggcuacgucaccguggcccacacggggcagcacgaccuggugaucccgcccaacggcuacuuccgguucgacagcugggucaaccaguucuacacccuggcgcccauggggaacggcaccggccgccgccgguga

SEQ ID NO: 11669 - RNA, 1617 nt, Artificial Sequence
  derived and/or modified sequence opt1 from VP1__Norovirus_and/or_Norovirus-like__HM635156
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaucgacggcgugcuccuggggaccacccagcucucccccgucaacaucugcaccuuccggggcgacgugacgcacaucaccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgccaaccagaacaccaaguucacccccgucggggugauccaggacggcaacacggcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucacgguggcccacaccggccagcacgaccuggugaucccgcccaacggguacuuccgguucgacagcugggucaaccaguucuacacccuggcgcccaugggcaacgggaccggccgccgccgguga

SEQ ID NO: 11670 - RNA, 1617 nt, Artificial Sequence
  derived and/or modified sequence opt1 from VP1__Norovirus_and/or_Norovirus-like__JQ622197
augaagauggccagcaacgacgccaaccccuccgacggcagcgcggccucccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggcgggaacguccacaacgugcaccuggccccggccguggcgcccaccuuccccggcgagcagcuccucuucuuccggagcacgaugcccggcugcuccggguacccgaacauggaccuggacugccugcucccccaggaguggguccagcacuucuaccaggaggccgcccccgcccagagcgacguggcgcugcugcgcuucgugaaccccgacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgguga

SEQ ID NO: 11671 - RNA, 1617 nt, Artificial Sequence
  derived and/or modified sequence opt1 from VP1__Norovirus_and/or_Norovirus-like__JQ613520
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucauccccagcaacggguacuuccgguucgacuccugggugaaccaguucuacacccucgcccccaugggcaacggcacggggcgccggcgcuga

SEQ ID NO: 11672 - RNA, 1617 nt, Artificial Sequence
  derived and/or modified sequence opt1 from VP1__Norovirus_and/or_Norovirus-like__HQ456320
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccaacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacacggggcagcacgaccuggugaucccgcccaacggcuacuuccgcuucgacuccugggugaaccaguucuacacccuggcccccauggggaacggcgcgggccggcgccgcuga

SEQ ID NO: 11673 - RNA, 1617 nt, Artificial Sequence
  derived and/or modified sequence opt1 from VP1__Norovirus_and/or_Norovirus-like__AB541353
augaagauggccagcaacgacgccucccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11674 - RNA, 1617 nt, Artificial Sequence
  derived and/or modified sequence opt1 from VP1__Norovirus_and/or_Norovirus-like__AB541348
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacgggggcaccacccaccgcaacgagccccagcagugggugcuccccuccuacagcgggcggaacguccacaacgugcaccuggcccccgcgguggccccgaacuuccccggcgagcagcuccucuucuuccgcuccaccaugcccggcugcagcggguaccccaacauggaccuggacugccugcucccgcaggaguggguccagcacuucuaccaggaggccgcccccgcgcaguccgacguggcccugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcuga

SEQ ID NO: 11675 - RNA, 1617 nt, Artificial Sequence
  derived and/or modified sequence opt1 from VP1__Norovirus_and/or_Norovirus-like__AB541339
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggaacaccacccaccgcaacgagccccagcagugggugcuccccagcuacuccggccggaacguccagaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11676 - RNA, 1617 nt, Artificial Sequence
  derived and/or modified sequence opt1 from VP1__Norovirus_and/or_Norovirus-like__AB541303
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccguguucacccccaagcuggggagcguccaguucagcacggacaccgagaacgacuucgagacccaccagaacaccaaguucacgccggugggcgugauccaggacggguccaccacccaccgcaacgagccccagcaguggguccuccccagcuacuccggccggaacgugcacaacgugcaccuggcccccgccgucgccccgaccuuccccggggagcagcuccucuucuuccgcagcacgaugcccggcugcuccggcuaccccaacauggaccuggacugccugcucccgcaggagugggugcagcacuucuaccaggaggccgcgcccgcccagagcgacguggcccugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcuga

SEQ ID NO: 11677 - RNA, 1617 nt, Artificial Sequence
  derived and/or modified sequence opt1 from VP1__Norovirus_and/or_Norovirus-like__GQ246799
augaagauggccagcaacgacgccaaccccuccgacggcagcgcggccaaccuggugccggagaucaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccccgccgggaacgccuucaccgccggcaagaucaucuucgccgccgugcccccgaacuuccccacggaggggcucagccccucccaggugaccauguucccccacaucaucguggacguccggcagcuggagccggugcugaucccccuccccgacgugcgcaacaacuucuaccacuacaaccagagcaacgacuccaccaucaagcugaucgccaugcuguacacgccccuccgggcgaacaacgccggcgacgacgucuucaccgugagcugccgcgugcugacccggccgucccccgacuucgacuucaucuuccuggucccgcccaccguggagagccgcaccaagccguucacggugcccauccucaccgucgaggagaugaccaacucccgguuccccaucccccuggagaagcuguucaccggcccgagcuccgccuucguggugcagccccagaacgggcgcugcacgaccgacggcguccuccuggggaccacccagcugagccccgugaacaucugcacguuccggggcgacgucacccacaucgccggcucccgcaacuacaccaugaaccucgccagccugaacuggaacaacuacgacccgaccgaggagauccccgcgccccuggggacgcccgacuucgugggcaagauccagggggugcucacccagaccaccaaggaggacggcuccacgcgggggcacaaggccaccgucuacaccggcagcgccgacuucaccccgaagcugggcagcgugcaguucgggacggacaccgagaacgacuucgagacccaccagaacaccaaguucacgcccgugggcgucauccaggacggguccaccacccaccgcaacgagccccagcagugggugcugcccagcuacuccggccggaacgugcacaacguccaccucgccccggccguggcgcccaacuuccccggggagcagcugcuguucuuccgcagcaccaugcccggcugcuccggcuacccgaacauggaccucgacugccugcugccccaggagugggugcagcacuucuaccaggaggccgcccccgcccagagcgacgucgcgcuccugcgguucgugaaccccgacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccggcgcuga

SEQ ID NO: 11678 - RNA, 1617 nt, Artificial Sequence
  derived and/or modified sequence opt1 from VP1__Norovirus_and/or_Norovirus-like__EU876886
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucuccagcgucaacaucugcacguuccgcggcgacgugacccacaucgccggcacccaggaguacaccaugaaccuggccucccagaacuggaacaacuacgaccccacggaggagaucccggcgccccuggggacccccgacuucgugggcaagauccaggggguccucacccagaccacgcggcgcgacggcagcacccgggggcacaaggccaccgugagcaccggcuccgugcacuucacgcccaagcugggccgcauccaguucagcaccgacaccuccaacgacuucgagaccgggcagaacacgcgguucaccccggucggcguggugcaggacgggagcaccacccaccagaacgagccccagcaguggguccugcccaacuacuccggccgcgacgggcacaacgugcaccucgcccccgccguggccccgagcuuccccggcgagcagcugcuguucuuccgguccacgaugcccggcugcagcggguaccccaacaugaaccucgacugccugcugccgcaggaguggguccagcacuucuaccaggaggccgcgcccgcccaguccgacguggcccuccugcgcuucgugaaccccgacaccggccggguccuguucgagugcaagcuccacaagagcggguacgugaccguggcccacaccggccagcacgaccuggucaucccgcccaacggguacuuccgcuucgacuccugggugaaccaguucuacacccuggcgcccaugggcaacggcacggggcgccggcgcuga

SEQ ID NO: 11679 - RNA, 1617 nt, Artificial Sequence
  derived and/or modified sequence opt1 from VP1__Norovirus_and/or_Norovirus-like__AB385630
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaaggaggacgggagcacgcggggccacaaggccaccguguacaccggcuccgcccccuucaccccgaagcuggggagcgugcaguucagcacggacaccgagaacgacuucgagacccaccagaacaccaaguucacgcccgucggcgugauccaggacggguccaccacccaccgcaacgagccccagcagugggugcuccccagcuacuccggccggaacguccacaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11680 - RNA, 1617 nt, Artificial Sequence
  derived and/or modified sequence opt1 from VP1__Norovirus_and/or_Norovirus-like__KU182483
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacacggggcagcacgaccuggugaucccgcccaacggcuacuuccgcuucgacuccugggugaaccaguucuacacccuggcccccauggggaacggcgcgggccggcgccgcuga

SEQ ID NO: 11681 - RNA, 1617 nt, Artificial Sequence
  derived and/or modified sequence opt1 from VP1__Norovirus_and/or_Norovirus-like__AB665364
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11682 - RNA, 1617 nt, Artificial Sequence
  derived and/or modified sequence opt1 from VP1__Norovirus_and/or_Norovirus-like__AB663686
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugaaccuggccagccuguccuggaacaacuacgaccccaccgaggagaucccggcgccccucgggacccccgacuucgugggcaagauccaggggguccugacgcagaccaccaagggcgacgggagcacccggggccacaaggccacgguguacaccggcagcgcccccuucaccccgaagcugggguccgugcaguucagcaccgacacggagaacgacuucgagacccaccagaacaccaaguucacccccgucggcgugauccaggacgggggcacgacccaccgcaacgagccccagcagugggugcuccccuccuacagcgggcggaacgucccgaacgugcaccuggcccccgccguggcgcccaccuuccccggcgagcagcuccucuucuuccgcuccaccaugccgggcugcagcggguaccccaacauggaccuggacugccugcucccccaggaguggguccagcacuucuaccaggaggccgcccccgcccaguccgacguggcgcugcugcgguucgugaacccggacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcuga

SEQ ID NO: 11683 - RNA, 1617 nt, Artificial Sequence
  derived and/or modified sequence opt1 from VP1__Norovirus_and/or_Norovirus-like__AB933702
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgucccgaacgugcaccuggcccccgccguggcgcccaccuuccccggggagcagcuccucuucuuccgcuccacgaugccgggcugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11684 - RNA, 1617 nt, Artificial Sequence
  derived and/or modified sequence opt1 from VP1__Norovirus_and/or_Norovirus-like__AB933685
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcgcuucuccacggacaccgagaacgacuucgagauccaccagaacaccaaguucacccccgugggcgucauccaggacgggagcacgacccaccggaacgagccccagcagugggugcuccccuccuacagcggccgcgacgcccacaacgugcaccuggccccggcggucgcccccaccuuccccggggagcagcuccucuucuuccgguccaccaugcccggcugcagcggcuacccgaacauggaccuggacugccugcucccccaggagugggugcagcacuucuaccaggaggccgcccccgcgcaguccgacguggcccugcugcgcuucgucaaccccgacacggggcggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcaccggccggcgccgcuga

SEQ ID NO: 11685 - RNA, 1617 nt, Artificial Sequence
  derived and/or modified sequence opt1 from VP1__Norovirus_and/or_Norovirus-like__AB933645
augaagauggccagcaacgacgccacccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccgcaacgagccccagcagugggugcuccccagcuacuccgggcggaacgucccgaacgugcaccuggcccccgccguggcgcccacguuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcuga

SEQ ID NO: 11686 - RNA, 1617 nt, Artificial Sequence
  derived and/or modified sequence opt1 from VP1__Norovirus_and/or_Norovirus-like__LC005706
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgcccacaacguccaccuggccccggcgguggcccccaccuuccccggggagcagcuccucuucuuccgcuccacgaugcccggcugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcuga

SEQ ID NO: 11687 - RNA, 1617 nt, Artificial Sequence
  derived and/or modified sequence opt1 from VP1__Norovirus_and/or_Norovirus-like__KM198562
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcgacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgaggcccaccagaacaccaaguucacccccgugggggucauccaggacggcgggacgacccaccgcaacgagccccagcagugggugcuccccuccuacagcggccgggacgugcacaacguccaccuggccccggcgguggcccccaccuuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacacggggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccaugggcaacgggaccggccgccggcgcuga

SEQ ID NO: 11688 - RNA, 1617 nt, Artificial Sequence
  derived and/or modified sequence opt1 from VP1__Norovirus_and/or_Norovirus-like__KC409311
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaugaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccugcuggggaccacccagcucucccccgugaacaucugcacguuccggggcgacgugacccacaucaccggcagccacaacuacaccaugaaccuggccacgcagaacuggaacuccuacgacccgaccgaggagauccccgcgccccuggggacccccgacuucgucggcaagauccagggggugcucacccagacgacccgcgccgacggcagcacccgggggcacaaggccaccguguacacgggcagcgccgacuucgccccgaagcugggccgcguccaguucgccaccgacaccaacaacgaccugggggccaaccagaacaccaaguucacgcccgugggcgugauccaggacgggggcaccgcgcaccggaacgagccccagcaguggguccuccccuccuacagcgggcgcaacucccacaacgugcaccuggccccggccguggcccccaccuuccccggcgagcagcuccucuucuuccggagcaccaugcccggcugcuccggguacccgaacauggaccuggacugccugcucccccaggaguggguccaguacuucuaccaggaggcggcccccgcccagagcgacguggcccugcugcgcuucgugaaccccgacacgggccggguccucuucgagugcaagcugcacaaguccggguacgugaccguggcccacaccggccagcacgaccuggucaucccgcccaacggguacuuccgcuucgacagcugggugaaccaguucuacacccucgcgcccaugggcaacggcaccgggcggcgccgcuga

SEQ ID NO: 11689 - RNA, 1617 nt, Artificial Sequence
  derived and/or modified sequence opt1 from VP1__Norovirus_and/or_Norovirus-like__KC409263
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgaggcccaccagaacaccaaguucacccccgucggggugauccaggacggcgggacgacccaccgcaacgagccccagcagugggugcuccccuccuacagcggccgggacguccacaacgugcaccuggccccggcgguggcccccaccuuccccggcgagcagcuccucuucuuccgcuccaccaugcccgggugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggaccggccgccggcgcuga

SEQ ID NO: 11690 - RNA, 1617 nt, Artificial Sequence
  derived and/or modified sequence opt1 from VP1__Norovirus_and/or_Norovirus-like__JX459900
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucgccggcagccgcaacuacaccaugaaccuggccucccagaacuggaacagcuacgaccccaccgaggagaucccggcgccccuggggacgcccgacuucgugggcaagauccaggggguccucacccagaccacccggacggacggcagcacccgcgggcacaaggccaccguguacaccggcuccgccgacuucagccccaagcugggccgggugcaguucgccacggacaccgacaacgacuucgacgccaaccagaacaccaaguucaccccggucggggugauccaggacggcaacacggcccaccgcaacgagccccagcagugggugcugcccuccuacagcgggcggaacacccacaacguccaccucgcgcccgccguggccccgaccuuccccggcgagcagcugcuguucuuccgcuccaccaugcccgggugcagcggcuaccccaacauggaccucgacugccugcugccgcaggagugggugcaguacuucuaccaggaggccgcgcccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 11691 - RNA, 1617 nt, Artificial Sequence
  derived and/or modified sequence opt1 from VP1__Norovirus_and/or_Norovirus-like__JX459617
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11692 - RNA, 1617 nt, Artificial Sequence
  derived and/or modified sequence opt1 from VP1__Norovirus_and/or_Norovirus-like__GQ845366
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccaacuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucauccccuccaacggguacuuccgguucgacagcugggugaaccaguucuacacccucgcccccaugggcaacggcacggggcgccggcgcuga

SEQ ID NO: 11693 - RNA, 1617 nt, Artificial Sequence
  derived and/or modified sequence opt1 from VP1__Norovirus_and/or_Norovirus-like__GQ845345
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggacaugaaccccuaccucagccaccuggcccgcauguacaacggcuacgccgggggcuucgaggugcaggucauccuggccgggaacgccuucacggcgggcaagaucaucuucgccgccgugccgcccaacuucccgaccgaggggcucucccccagccaggugaccauguucccccacaucaucgucgacgugcggcagcuggagcccgugcugaucccgcuccccgacguccgcaacaacuucuaccacuacaaccaguccaacgaccccaccaucaagcugaucgccaugcuguacacgccccuccgggccaacaacgcgggcgacgacguguucaccgugagcugccgcguccugacccggccgucccccgacuucgacuucaucuuccuggugccgcccaccguggagagccgcacgaagcccuucuccguccccauccucaccguggaggagaugaccaacagccgguuccccaucccccuggagaagcuguucaccggcccguccagcgccuucgugguccagccccagaacgggcgcugcacgaccgacggcgugcuccuggggaccacccagcugucccccgucaacaucugcacguuccggggcgacgugacccacaucgccggcagccgcaacuacaccaugaaccucgccucccagaacuggaacagcuacgacccgaccgaggagauccccgcgccccuggggacgcccgacuucgugggcaagauccaggggguccugacccagaccacccggacggacggcagcacccgcgggcacaaggccaccguguacaccggcuccgccgacuucagcccgaagcucggccgggugcaguucgccacggacaccgacaacgacuucgucgccaaccagaacaccaaguucacccccgugggggugauccaggacggcaacacggcccaccgcaacgagccccagcaguggguccugcccuccuacagcgggcggaacacccacaacgugcaccuggcgccggccguggcccccaccuuccccggcgagcagcuccuguucuuccgcuccaccaugcccgggugcagcggcuacccgaacauggaccuggacugccuccugccccaggaguggguccaguacuucuaccaggaggccgcgcccgcccaguccgacguggcccugcuccgguucgugaaccccgacacgggccgcguccuguucgagugcaagcugcacaagagcggguacgugaccguggcccacaccggccagcacgaccucgucaucccgcccaacggguacuuccgguucgacuccugggugaaccaguucuacacccuggcccccaugggcaacgggaccggccgccgccgguga

SEQ ID NO: 11694 - RNA, 1617 nt, Artificial Sequence
  derived and/or modified sequence opt1 from VP1__Norovirus_and/or_Norovirus-like__GQ845341
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccgagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11695 - RNA, 1617 nt, Artificial Sequence
  derived and/or modified sequence opt1 from VP1__Norovirus_and/or_Norovirus-like__HQ005292
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucuccccgaagcugggccgggugcaguucgccacggacaccgacaacgacuucgacgccaaccagaacaccaaguucacccccgucggggugauccaggacggcaacacggcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacaccggccgcgugcuguucgagugcaagcuccacaagagcggguacgucacgguggcccacaccggccagcacgaccuggugaucccgcccaacggguacuuccgguucgacuccugggucaaccaguucuacacccuggcgcccaugggcaacgggaccggccgccgccgguga

SEQ ID NO: 11696 - RNA, 1617 nt, Artificial Sequence
  derived and/or modified sequence opt1 from VP1__Norovirus_and/or_Norovirus-like__HQ456321
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacggugaaccuggccucccagaacuggaacaacuacgacccgaccgaggagauccccgcgccccuggggacccccgacuucgucggcaagauccagggggugcucacccagacgacccgccgggacggcagcacccgcgggcacaaggccaccguguccacgggcagcguccacuucaccccgaagcugggcagcgugcaguucuccaccgacaccagcaacgacuucgagacggggcagaacacccgguucacccccgugggcgucgugcaggacggguccaccacgcaccagaacgagccccagcagugggugcugcccaacuacagcggccgcgacucccacaacguccaccucgccccggccguggcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacgucgcccuccugcgcuucgugaaccccgacaccgggcgggugcuguucgagugcaagcuccacaagagcggcuacgucaccguggcccacacggggcagcacgaccuggugaucccgcccaacggcuacuuccgcuucgacuccugggucaaccaguucuacacccuggcccccauggggaacggcgcgggccggcgccgcuga

SEQ ID NO: 11697 - RNA, 1617 nt, Artificial Sequence
  derived and/or modified sequence opt1 from VP1__Norovirus_and/or_Norovirus-like__AB541326
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucaccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgccgacuucacgcccaagcuggggagcgugcaguucgccaccgacaccgagaacgacuucgagacccaccagaacacgaaguucaccccggucggcgugauccaggacgggggcaccacccaccgcaacgagccccagcagugggugcuccccuccuacagcgggcggaacguccacaacgugcaccuggcccccgccguggcgccgaacuuccccggcgagcagcuccucuucuuccgcuccacgaugcccggcugcagcggguaccccaacauggaccuggacugccugcucccgcaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11698 - RNA, 1617 nt, Artificial Sequence
  derived and/or modified sequence opt1 from VP1__Norovirus_and/or_Norovirus-like__AB541251
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggugucccugaacuggaacaacuacgaccccaccgaggagaucccggcgccccucgggacgcccgacuucgucggcaagauccagggggugcugacccagaccaccaagggcgacgggagcacgcggggccacaaggccaccguguacaccggcagcgcccccuucaccccgaagcugggguccguccaguucagcacggacaccgagaacgacuucgagacccaccagaacaccaaguucacgcccgugggcgugauccaggacggguccaccacccaccgcaacgagccccagcaguggguccuccccagcuacuccggccggaacgugcacaacgugcaccuggccccggccgucgcccccaccuuccccggggagcagcuccucuucuuccgcagcacgaugcccggcugcuccggcuacccgaacauggaccuggacugccugcucccccaggagugggugcagcacuucuaccaggaggcggcccccgcccagagcgacguggcccugcugcgguucgucaaccccgacaccgggcgcguccucuucgagugcaagcugcacaaguccggcuacgugaccguggcguacaccgggcagcacgaccuggugaucccgcccaacggcuacuuccgguucgacagcugggugaaccaguucuacacccucgcccccauggggaacggcacgggccgccggcgcuga

SEQ ID NO: 11699 - RNA, 1617 nt, Artificial Sequence
  derived and/or modified sequence opt1 from VP1__Norovirus_and/or_Norovirus-like__AB541241
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccaucgagagccgcaccaagcccuucacggugcccauccugaccgucgaggagaugaccaacucccgguuccccaucccccuggagaagcuguucaccggccccagcggggccuucguggugcagccgcagaacggccgcugcacgaccgacgggguccugcugggcaccacccagcucucccccgugaacaucugcacguuccggggcgacgucacccacaucgccgggagccgcgacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgagacccaccagaacaccaaguucacgcccgugggggucauccaggacggcuccaccacccaccgcaacgagccccagcagugggugcuccccagcuacuccgggcggggcgugcacaacguccaccuggccccggccguggcgcccaccuuccccggcgagcagcuccucuucuuccgcagcacgaugcccgggugcuccggcuacccgaacauggaccuggacugccugcucccccaggagugggugcagcacuucuaccaggaggccgcccccgcccagagcgacgucgcgcugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccaugggcaacgggacgggccgccggcgcuga

SEQ ID NO: 11700 - RNA, 1617 nt, Artificial Sequence
  derived and/or modified sequence opt1 from VP1__Norovirus_and/or_Norovirus-like__AB541216
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucuccacggacaccgagaacgacuucgagacccaccagaacaccaaguucacgccggucggcgugauccaggacgggggcaccacccaccgcaacgagccccagcagugggugcuccccagcuacuccgggcggaacguccacaacgugcaccuggcccccgccguggcgccgaccuuccccggcgagcagcuccucuucuuccgcagcacgaugcccggcugcuccggguaccccaacauggaccuggacugccugcucccgcaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11701 - RNA, 1617 nt, Artificial Sequence
  derived and/or modified sequence opt1 from VP1__Norovirus_and/or_Norovirus-like__EU876885
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgccaacaucugcacguuccgcggcgacgucacccacaucgccggcacccaggaguacaccaugaaccuggccagccagaacuggaacaacuacgacccgacggaggagauccccgcgccccuggggacccccgacuucgugggcaagauccagggggugcucacccagaccacgcggcgcgacggcuccacccgggggcacaaggccaccgucagcaccggcagcgugcacuucacgccgaagcugggccgcauccaguucuccaccgacaccagcaacgacuucgagaccgggcagaacacgcgguucacccccgugggcgucgugcaggacgggggcaccacccaccagaacgagccccagcagugggugcugcccaacuacuccgggcgcgacggccacaacguccaccucgccccggccguggcccccagcuuccccggcgagcagcugcuguucuuccgguccacgaugcccgggugcagcggcuacccgaacaugaaccucgacugccugcugccccaggagugggugcagcacuucuaccaggaggcggcccccgcccaguccgacgucgcccuccugcgcuucgugaaccccgacaccgggcgggugcuguucgagugcaagcuccacaagagcggcuacgucaccguggcgcacaccgggcagcacgaccuggugaucccgcccaacggcuacuuccgcuucgacuccugggucaaccaguucuacacccuggcccccaugggcaacgggacgggccgccggcgcuga

SEQ ID NO: 11702 - RNA, 1617 nt, Artificial Sequence
  derived and/or modified sequence opt1 from VP1__Norovirus_and/or_Norovirus-like__AB447435
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgacagcaccaucaagcucaucgccaugcuguacacgccccugcgggcgaacaacgccggcgaggacguguucaccguguccugccgcguccucacccggcccagcccggacuucgacuucaucuuccuggugccgcccaccguggagucccgcacgaagcccuucaccguccccauccugaccguggaggagaugaccaacagccgguuccccaucccccucgagaagcuguucacgggccccuccggggccuucgugguccagccgcagaacggccgcugcaccaccgacggggugcugcucggcaccacgcagcugagccccgucaacaucugcaccuuccggggcgacgugacccacaucgccgggucccgcaacuacaccaugaaccuggccagccucaacuggaacaacuacgaccccacggaggagaucccggcgccccugggcacccccgacuucguggggaagauccagggcguccugacccagaccacgaagggggacggcuccacccggggccacaaggccaccguguacaccgggagcgcccccuucacgccgaagcucggcuccgugcaguucagcaccgacaccgagaacgacuucgagacccaccagaacacgaaguucacccccgucggggugauccaggacggcagcaccacccaccgcaacgagccccagcagugggugcugcccuccuacagcgggcggaacguccacaacgugcaccuggccccggccguggcgcccacguuccccggcgagcagcuccuguucuuccgcuccaccaugcccggcugcagcggguacccgaacauggaccuggacugccuccugccccaggaguggguccagcacuucuaccaggaggccgcccccgcccaguccgacguggcgcugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacgcuggcccccaugggcaacggcaccgggcgccggcgcuga

SEQ ID NO: 11703 - RNA, 1617 nt, Artificial Sequence
  derived and/or modified sequence opt1 from VP1__Norovirus_and/or_Norovirus-like__KX354073
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacacccgcuucacgccggucggcgugauccaggacggguccaccacccaccggaacgagccccagcagugggugcuccccagcuacuccggccgcaacguccacaacgugcaccuggcccccgcgguggccccgaacuuccccggggagcagcuccucuucuuccggagcaccaugcccggcugcuccggcuaccccaacauggaccuggacugccugcucccgcaggaguggguccagcacuucuaccaggaggccgcccccgcgcagagcgacguggcccugcugcgcuucgugaaccccgacacggggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccauggggaacggcaccggccggcgccgcuga

SEQ ID NO: 11704 - RNA, 1617 nt, Artificial Sequence
  derived and/or modified sequence opt1 from VP1__Norovirus_and/or_Norovirus-like__KX353981
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11705 - RNA, 1617 nt, Artificial Sequence
  derived and/or modified sequence opt1 from VP1__Norovirus_and/or_Norovirus-like__KU182479
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcgcccagaacuacaccaugaaccuggccucccagaacuggaacaacuacgacccgacggaggagauccccgcgccccuggggacccccgacuucgugggcaagauccaggggguccucacccagaccacgcgccgggacggcagcacccgcgggcacaaggccaccguguccaccggcagcgugcacuucacgccgaagcugggcagcguccaguucuccaccgacaccagcaacgacuucgagaccgggcagaacacgcgguucacccccgugggcgugguccaggacggguccaccacccaccagaacgagccccagcagugggugcugcccgacuacagcggccgcgacucccacaacgugcaccucgccccggccgucgcccccacguuccccggggagcagcugcuguucuuccggagcaccaugcccggcugcuccggcuacccgaacaugaaccucgacugccugcugccccaggagugggugcagcacuucuaccaggagagcgcgcccgcccaguccgacguggcccuccugcgcuucgucaaccccgacaccgggcgggugcuguucgagugcaagcuccacaagagcggcuacgugaccgucgcccacaccgggcagcacgaccuggugaucccgcccaacggcuacuuccgcuucgacuccugggugaaccaguucuacacgcuggcgcccauggggaacggcgccggccggcgccgcuga

SEQ ID NO: 11706 - RNA, 1617 nt, Artificial Sequence
  derived and/or modified sequence opt1 from VP1__Norovirus_and/or_Norovirus-like__KU182478
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacacggggcagcacgaccuggugaucccgcccaacggcuacuuccgcuucgacuccuggaucaaccaguucuacacccuggcccccauggggaacggcgcgggccggcgccgcuga

SEQ ID NO: 11707 - RNA, 1617 nt, Artificial Sequence
  derived and/or modified sequence opt1 from VP1__Norovirus_and/or_Norovirus-like__AB972501
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucggcacggacaccgagaacgacuucgagacccaccagaacaccaaguucacgcccgucggggugauccaggacggcgggaccacccaccgcaacgagccccagcagugggugcuccccuccuacagcggccggaacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagcccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 11708 - RNA, 1617 nt, Artificial Sequence
  derived and/or modified sequence opt1 from VP1__Norovirus_and/or_Norovirus-like__KR904214
augaagauggccagcuccgacgccaaccccagcgugggcuccgcggccaaccugguccccgaggugaacaacgaggugauggcccucgagcccgucgugggggccgccaucgcggcccccguggccggccagcagaacgucaucgaccccuggauccgcaacaacuucgugcaggcccccgggggcgaguucaccgugagcccccggaacgcgcccggggagauccugugguccgcgccccugggcccggaccucaaccccuaccugagccaccuggcccgcauguacaacggcuacgccgggggcuucgagguccucgugauccuggccgggaacgccuucaccgccggcaagaucaucuucgccgccgugccgcccaacuucccgacggaggggcugucccccagccaggucaccauguucccccacaucaucguggacgugcggcagcucgagcccguccugaucccgcugcccgacgugcgcaacaacuucuaccacuacaaccaguccaacgaccccaccaucaagcucaucgccaugcuguacacgccccugcgggcgaacaacgccggcgacgacguguucaccgucagcugccgcgugcucacccggccgucccccgacuucgacuucaucuuccuggugccgcccaccgucgagagccgcaccaagcccuucuccgugcccauccugacgguggaggagaugaccaacagccgguuccccaucccccucgagaagcuguucaccggcccguccagcgccuucgucgugcagccccagaacgggcgcugcaccacggacggcguccugcucgggaccacccagcugucccccgugaacaucugcaccuuccggggcgacgugacgcacaccaccggcagccacaacuacaccaugaaccuggccacgcagaacuggaacuccuacgacccgaccgaggagauccccgcgccccucgggacccccgacuucgucggcaagauccagggggugcugacccagacgaccaagaccgacggcagcacccgcgggcacaaggccacgguguacaccggcagcgccgacuucgccccgaagcugggccggguccaguucgccaccgacaccgacaacgacuucgaggccaaccagaacacgaaguucacccccgugggggugauccaggacggcgggaccgcgcaccgcaacgagccccagcaguggguccuccccuccuacagcggccggaacacccacaacgugcaccuggccccggccguggcccccacguuccccggggagcagcuccuguucuuccgcuccaccaugcccggcugcagcggcuacccgaacauggaccuggacugccugcucccccaggaguggguccaguacuucuaccaggaggcggcccccgcccaguccgacguggcccugcugcgguucgugaaccccgacaccgggcgcguccucuucgagugcaagcugcacaagagcggcuacgugaccguggcccacaccgggccgcacgaccuggucaucccgcccaacggcuacuuccgguucgacuccugggugaaccaguucuacacgcucgcgcccauggggaacggcaccggccgccggcgcuga

SEQ ID NO: 11709 - RNA, 1617 nt, Artificial Sequence
  derived and/or modified sequence opt1 from VP1__Norovirus_and/or_Norovirus-like__AB933758
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccacaacuacaccaugaaccuggccucccagaacuggaacagcuacgacccgaccgaggagauccccgcgccccuggggacgcccgacuucgugggcaagauccaggggguccucacccagaccacccgcacggacggcagcacccgggggcacaaggccaccguguacaccggcuccgccgaguucagcccgaagcugggccgcgugcaguucgccacggacaccaacaacgacuucgacgccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcuga

SEQ ID NO: 11710 - RNA, 1617 nt, Artificial Sequence
  derived and/or modified sequence opt1 from VP1__Norovirus_and/or_Norovirus-like__AB933698
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguucaagggcgacgugacccacaucgccgggagccggaacuacaccaugaaccuggccucccugaacuggaacaacuacgaccccaccgaggagaucccggcgccccucggcacgcccgacuucguggggaagauccagggcguccugacccagaccaccaagggggacggcagcacgcgcggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccagaacgagccccagcagugggugcuccccuccuacagcggccgggacgucccgaacgugcaccuggcccccgccguggcgcccaccuuccccggcgagcagcuccucuucuuccgcuccacgaugccggggugcagcggcuaccccaacaugaaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11711 - RNA, 1617 nt, Artificial Sequence
  derived and/or modified sequence opt1 from VP1__Norovirus_and/or_Norovirus-like__KJ678141
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcugcuggggaccacccagcucagccccgucaacaucugcaccuuccggggcgacgugacgcacaucaccggcucccacaacuacaccaugaaccuggccagccagaacuggagcaacuacgacccgaccgaggagauccccgcgccccuggggacgcccgacuucgugggcaagauccaggggguccucacccagaccacccgcacgaacggcuccacccgggggcacaaggccaccguguacgccggcagcgccaacuucgccccgaagcugggccgcgugcaguucgagaccgacacggaccacgaccuggaggccaaccagaacaccaaguucacccccgucggggugauccaggacggcaacaccacgcaccggaacgagccccagcagugggugcuccccuccuacagcgggcgcuccaccccgaacguccaccuggcgcccgccguggcccccaccuuccccggcgagcagcuccucuucuuccggagcaccaugccggggugcuccggcuaccccaacauggaccuggacugccugcucccccaggagugggugcaguacuucuaccaggaggccgcgcccgcccagagcgacgucgcccugcugcgcuucgugaacccggacacgggccggguccucuucgagugcaagcugcacaaguccggguacgugaccguggcccacaccggccagcacgaccuggugaucccgcccaacggguacuuccgcuucgacagcugggucaaccaguucuacacccucgcccccaugggcaacgggaccggccggcgccgcuga

SEQ ID NO: 11712 - RNA, 1617 nt, Artificial Sequence
  derived and/or modified sequence opt1 from VP1__Norovirus_and/or_Norovirus-like__EU921347
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagguccuccuggccgggaacgccuucacggcgggcaagaucaucuucgccgccgugccgcccaacuucccgaccgaggggcugucccccagccaggugaccauguucccccacaucaucgucgacgugcggcagcucgagcccgugcugaucccgcugcccgacguccgcaacaacuucuaccacuacaaccaguccaacgaccccaccaucaagcucaucgccaugcuguacacgccccugcgggccaacaacgcgggcgacgacguguucaccgugagcugccgcguccucacccggccgucccccgacuucgacuucaucuuccuggugccgcccaccguggagagccgcacgaagcccuucuccguccccauccugaccguggaggagaugaccaacagccgguuccccaucccccucgagcgccuguucaccggcccguccagcgccuucgugguccagccccagaacgggcggugcacgaccgacggcgugcugcucgggaccacccagcugucccccgucaacaucugcacguuccgcggcgacgugacccacaucgccggcacccaggaguacaccaugaaccuggccagccagaacuggaacaacuacgacccgacggaggagauccccgcgccccucgggacccccgacuucgugggcaagauccaggggguccugacccagaccacgcggcgcgacggcuccacccgggggcacaaggccaccgugagcaccggcagcgugcacuucacgccgaagcugggccgcauccaguucuccaccgacaccagcaacgacuucgagaccgggcagaacacgcgguucacccccgucggcguggugcaggacgggggcaccacccaccagaacgagccccagcaguggguccuccccgacuacuccgggcgcgacagccacaacgugcaccuggccccggccguggcccccuccuuccccggcgagcagcuccuguucuuccggagcacgaugcccggcugcuccggguacccgaacaugaaccuggacugccugcucccccaggaguggguccagcacuucuaccaggaggccgcgcccgcccagagcgacguggcccugcugcgcuucgugaaccccgacaccggccggguccucuucgagugcaagcugcacaaguccggguacgugaccguggcccacaccggccagcacgaccuggucaucccgcccaacggguacuuccgcuucgacagcugggugaaccaguucuacacccucgcgcccaugggcaacggcacggggcgccggcgcuga

SEQ ID NO: 11713 - RNA, 1617 nt, Artificial Sequence
  derived and/or modified sequence opt1 from VP1__Norovirus_and/or_Norovirus-like__JX459628
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaccuuccccggcgagcagcuccucuucuuccgcuccacgaugcccggcugcagcggguaccccaacauggaccuggacugccugcucccgcaggaguggguccagcacuucuaccaggaggccgcccccgcgcaguccgacguggcccugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11714 - RNA, 1617 nt, Artificial Sequence
  derived and/or modified sequence opt1 from VP1__Norovirus_and/or_Norovirus-like__JQ613564
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaccgccggcagccacaacuacaccaugaaccuggccucccagaacuggaacagcuacgacccgacggaggagauccccgcgccccuggggacccccgacuucgugggcaagauccaggggguccucacccagaccacgcgcgccgacggcagcacccgggggcacaaggccaccguguacaccggcuccgccgaguucagcccgaagcugggccgcgugcaguucgccacggacaccgacaacgacuucgacgccaaccagaacaccaaguucacccccgucggggugauccaggacggcgggacgacccaccggaacgagccccagcagugggugcugcccuccuacagcggccgcaacacccacaacguccaccucgcgccggccguggcccccaccuuccccggggagcagcugcuguucuuccgguccacgaugcccggcugcagcggcuacccgaacauggaccucgacugccugcugccccaggagugggugcaguacuucuaccaggaggccgcgcccgcccaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcuga

SEQ ID NO: 11715 - RNA, 1617 nt, Artificial Sequence
  derived and/or modified sequence opt1 from VP1__Norovirus_and/or_Norovirus-like__GQ845332
augaagauggccagcaacgacgccaaccccuccaacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11716 - RNA, 1617 nt, Artificial Sequence
  derived and/or modified sequence opt1 from VP1__Norovirus_and/or_Norovirus-like__GQ856461
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucaugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcggaacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11717 - RNA, 1617 nt, Artificial Sequence
  derived and/or modified sequence opt1 from VP1__Norovirus_and/or_Norovirus-like__AB541245
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacaucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgcccacaacgugcaccuggccccggcggucgcccccaccuuccccggggagcagcuccucuucuuccgcuccacgaugcccggcugcagcggcuacccgaacauggaccuggacugccugcucccccaggagugggugcagcacuucuaccaggaggccgcccccgcgcaguccgacguggcccugcugcgguucgucaaccccgacaccgggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgccggcgcuga

SEQ ID NO: 11718 - RNA, 1617 nt, Artificial Sequence
  derived and/or modified sequence opt1 from VP1__Norovirus_and/or_Norovirus-like__AB541229
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcgccggccgccggcgcuga

SEQ ID NO: 11719 - RNA, 1617 nt, Artificial Sequence
  derived and/or modified sequence opt1 from VP1__Norovirus_and/or_Norovirus-like__AB541226
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaucaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacaccaaguucacccccgucggcgugauccaggacgggagcacgacccaccgcaacgagccccagcagugggugcuccccuccuacagcggccggaacguccacaacgugcaccuggccccggccguggcgcccaccuuccccggggagcagcuccucuucuuccgcuccaccaugcccggcugcagcggcuacccgaacauggaccuggacugccugcucccccaggaguggguccagcacuucuaccaggaggccgcccccgcccaguccgacguggcgcugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucacccccauggggaacggcacgggccgccggcgcuga

SEQ ID NO: 11720 - RNA, 1617 nt, Artificial Sequence
  derived and/or modified sequence opt1 from VP1__Norovirus_and/or_Norovirus-like__DQ078814
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggugcugagccccucccaggucaccauguucccccacaucaucguggacgugcggcagcuggagcccguccucaucccgcugcccgacgugcgcaacaaccuguaccacuacaaccagagcaacgaccccacgauccggcucaucgccaugcuguacacgccccugcgcgccaacaacgcgggggacgacguguucaccgucuccugccgggugcucacccgcccgagccccgacuucgacuucaucuuccuggugccgcccaccgucgagucccggaccaagcccuucagcgugcccauccugaccguggaggagaugaccaacucccgcuuccccaucccccucgagaagcuguucacgggcccgagcuccgccuucgucgugcagccccagaacggccggugcaccaccgacgggguccugcucggcaccacgcagcugagccccgugaacaucugcaccuuccgcggggacgugacccacaucgccggcacccagaacuacacgaugaaccuggccucccagaacuggaacaacuacgacccgaccgaggagauccccgcgccccucggcacccccgacuucgucgggcggauccagggcgugcugacccagacgacccgccgggacgggagcacccgcggccacaaggccaccguguccacggggagcguccacuucaccccgaagcugggcagcgugcaguucuccaccgacaccagcaacgacuucgagacgggccagaacacccgguucacccccgugggggucgugcaggacggcuccaccacgcaccagaacgagccccagcagugggugcuccccgacuacagcgggcgcgacucccacaacguccaccuggccccggccguggcccccaccuuccccggcgagcagcuccucuucuuccggagcaccaugcccgggugcuccggcuacccgaacaugaaccuggacugccugcucccccaggagugggugcagcacuucuaccaggagagcgcccccgcgcaguccgacgucgcccugcugcgcuucgugaaccccgacaccggccgggugcuguucgagugcaagcugcacaagagcggguacgucaccguggcccacacgggccagcacgaccuggugaucccgcccaacggguacuuccgcuucgacuccugggucaaccaguucuacacccucgcccccaugggcaacggggcgggccgccggcgcuga

SEQ ID NO: 11721 - RNA, 1617 nt, Artificial Sequence
  derived and/or modified sequence opt1 from VP1__Norovirus_and/or_Norovirus-like__EU078416
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcgccuucgugguccagccgcagaacgggcgcugcaccacggacggcgugcuccuggggaccacccagcucucccccgucaacaucugcaccuuccggggcgacgugacgcacaucgccggcacccaggaguacaccaugaaccuggccagccagaacuggaacaacuacgaccccaccgaggagaucccggcgccccuggggacgcccgacuucgugggcaagauccaggggguccucacccagaccacccgccgggacggcuccacgcgcgggcacaaggccaccgugagcaccggcagcgugcacuucacccccaagcugggccggauccaguucuccacggacaccagcaacgacuucgagaccgggcagaacacccgcuucacgccggucggcguggugcaggacggguccaccacccaccagaacgagccccagcaguggguccugcccaacuacagcggccgggacucccacaacgugcaccucgcccccgccguggccccgagcuuccccggggagcagcugcuguucuuccgcuccaccaugcccggcugcagcggcuaccccaacauggaccucgacugccugcugccgcaggaguggguccagcacuucuaccaggaggcggcccccgcccaguccgacguggcccuccugcgguucgugaaccccgacacggggcgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcaccggccgccgccgguga

SEQ ID NO: 11722 - RNA, 1617 nt, Artificial Sequence
  derived and/or modified sequence opt1 from VP1__Norovirus_and/or_Norovirus-like__EU839590
augaagauggccagcaacgacgccaaccccuccggcgggagcgcggccaaccuggugccggaggucaacaacgaggugauggcccucgagcccguggucggcgccgccaucgcggcccccguggccgggcagcagaacgugaucgaccccuggauccgcaacaacuucguccaggccccgggcggggaguucaccgugagcccccggaacgcgcccggcgagauccugugguccgcgccccugggcccggaccucaaccccuaccugucccaccuggcccgcauguacaacggguacgccggcggguucgaggugcaggucauccucgccggcaacgccuucaccgccgggaagaucaucuucgccgccgugccgcccaacuuccccacggagggccugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccgggcccagcuccgccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccaggacaccaaguucacgcccgucggggugauccaggacggcgggaccacccaccgcaacgagccccagcagugggugcuccccagcuacuccggccggaacguccagaacgugcaccuggccccggccguggcgcccaccuuccccggcgagcagcuccucuucuuccgcagcacgaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 11723 - RNA, 1617 nt, Artificial Sequence
  derived and/or modified sequence opt1 from VP1__Norovirus_and/or_Norovirus-like__AB294783
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccguguccacgggcagcgugcacuucaccccgaagcuggggagcguccaguucuccaccgacaccagcaacgacuucgagacgggccagaacacccgcuucacccccgugggggugguccaggacggcuccaccacgcaccagaacgagccccagcagugggugcugcccaacuacagcgggcgggacucccacaacgugcaccucgccccggccgucgcccccaccuuccccggcgagcagcugcuguucuuccgcagcaccaugcccggcugcuccggguacccgaacaugaaccucgacugccugcugccccaggagugggugcagcacuucuaccaggagagcgcccccgcgcaguccgacguggcccuccugcgguucgucaaccccgacaccggccgcgugcuguucgagugcaagcuccacaagagcggguacgugaccgucgcccacacgggccagcacgaccuggugaucccgcccaacggguacuuccgguucgacuccugggugaaccaguucuacacccuggcccccaugggcaacggcgcggggcgccggcgcuga

SEQ ID NO: 11724 - RNA, 1617 nt, Artificial Sequence
  derived and/or modified sequence opt1 from VP1__Norovirus_and/or_Norovirus-like__AB303941
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcauccacuucaccccgaagcugggcagcgugcaguucuccaccgacaccagcaacgacuucgagacggggcagaacacccgguucacccccgucggcguggugcaggacggguccaccacgcaccagaacgagccccagcaguggguccugcccgacuacagcggccgcgacucccacaacgugcaccucgccccggccguggcccccaccuuccccggggagcagcugcuguucuuccggagcaccaugcccggcugcuccggcuacccgaacaugaaccucgacugccugcugccccaggaguggguccagcacuucuaccaggagagcgcccccgcgcaguccgacguggcccuccugcgcuucgugaaccccgacaccgggcggguccuguucgagugcaagcuccacaagagcggcuacgugaccguggcccacacggggcagcacgaccuggucaucccgcccaacggcuacuuccgcuucgacuccugggugaaccaguucuacacccuggcccccauggggaacggcgcgggccggcgccgcuga

SEQ ID NO: 11725 - RNA, 1617 nt, Artificial Sequence
  derived and/or modified sequence opt1 from VP1__Norovirus_and/or_Norovirus-like__EF126961
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgaggccgggcagaacacgcgguucacccccgugggcgugguccaggacggguccaccacccaccagaacgagccccagcagugggugcugcccgacuacagcggccgcgacucccacaacgugcaccucgccccggccgucgcccccacguuccccggggagcagcugcuguucuuccggagcaccaugcccggcugcuccggcuacccgaacaugaaccucgacugccugcugccccaggagugggugcagcacuucuaccaggagagcgcgcccgcccaguccgacguggcccuccugcgcuucgucaaccccgacaccgggcgggugcuguucgagugcaagcuccacaagagcggcuacgugaccgucgccuacaccgggcagcacgaccuggugaucccgcccaacggcuacuuccgcuucgacuccugggugaaccaguucuacacgcuggcgcccauggggaacggcgccggccggcgccgcuga

SEQ ID NO: 11726 - RNA, 1617 nt, Artificial Sequence
  derived and/or modified sequence opt1 from VP1__Norovirus_and/or_Norovirus-like__LC153749
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccaggacaccaaguucacgcccgucggcgugauccaggacgggggcaccacccaccgcaacgagccccagcagugggugcuccccagcuacuccgggcgggacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11727 - RNA, 1617 nt, Artificial Sequence
  derived and/or modified sequence opt1 from VP1__Norovirus_and/or_Norovirus-like__KX371610
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgggacggacaccgaccacgacuucgaggccaaccagagcaccaaguucacccccgucggcgugauccaggacggguccacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 11728 - RNA, 1617 nt, Artificial Sequence
  derived and/or modified sequence opt1 from VP1__Norovirus_and/or_Norovirus-like__KX354031
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgggacggacaccgaccacgacuucgaggccaaccagaacaccaaguucacccccgucggcgugauccaggacggguccacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 11729 - RNA, 1617 nt, Artificial Sequence
  derived and/or modified sequence opt1 from VP1__Norovirus_and/or_Norovirus-like__KX353990
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucgccggcucccgcaacuacaccaugaaccuggccagccagaacuggaacuccuacgacccgaccgaggagauccccgcgccccuggggacgcccgacuucgucggcaagauccagggggugcucacccagaccacccggacggacggcagcacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacccaccgcaacgagccccagcaguggguccugcccagcuacuccggccggaacacccacaacgugcaccucgccccggccguggcgcccacguuccccggggagcagcugcuguucuuccgcagcaccaugcccggcugcuccggcuacccgaacauggaccucgacugccugcugccccaggaguggguccaguacuucuaccaggaggccgcccccgcccagagcgacguggcgcuccugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacgcuggcccccauggggaacggcaccggccgccgccgguga

SEQ ID NO: 11730 - RNA, 1617 nt, Artificial Sequence
  derived and/or modified sequence opt1 from VP1__Norovirus_and/or_Norovirus-like__KX353972
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucaccggcucccgcaacuacaccaugaaccuggccagccagaacuggaacuccuacgacccgacggaggagauccccgcgccccuggggacccccgacuucgucggcaagauccagggggugcucacccagaccacgcggaccgacggcagcacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcgggaccacccaccgcaacgagccccagcaguggguccugcccagcuacuccggccggaacacgcacaacgugcaccucgccccggccguggcccccaccuuccccggggagcagcugcuguucuuccgcagcaccaugcccggcugcuccggcuacccgaacauggaccucgacugccugcugccccaggaguggguccaguacuucuaccaggaggcggcccccgcccagagcgacguggcccuccugcgguucgugaaccccgacaccgggcgcguccuguucgagugcaagcuccacaaguccggcuacgugaccguggcgcacacggggcagcacgaccuggucaucccgcccaacggcuacuuccgguucgacagcugggugaaccaguucuacacccuggcccccauggggaacggcaccggccgccgccgguga

SEQ ID NO: 11731 - RNA, 1617 nt, Artificial Sequence
  derived and/or modified sequence opt1 from VP1__Norovirus_and/or_Norovirus-like__KX353968
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacacccgcuucacgccggucggcgugauccaggacgggggcaccacccaccggaacgagccccagcagugggugcuccccuccuacagcgggcgcaacauccacaacguccaccuggcccccgcgguggccccgaacuuccccggcgagcagcuccucuucuuccgguccaccaugcccggcugcagcggguaccccaacauggaccuggacugccugcucccgcaggagugggugcagcacuucuaccaggaggccgcccccgcgcaguccgacgucgcccugcugcgcuucgugaaccccgacacgggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacggcaccgggcggcgccgcuga

SEQ ID NO: 11732 - RNA, 1617 nt, Artificial Sequence
  derived and/or modified sequence opt1 from VP1__Norovirus_and/or_Norovirus-like__KX353967
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacacccgcuucacgccggucggcgugauccaggacgggggcaccacccaccggaacgagccccagcagugggugcuccccuccuacagcgggcgcaacauccacaacguccaccuggcccccgcgguggccccgaacuuccccggcgagcagcuccucuucuuccgguccaccaugcccggcugcagcggguaccccaacguggaccuggacugccugcucccgcaggaguggguccagcacuucuaccaggaggccgcccccgcgcaguccgacguggcccugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgcuga

SEQ ID NO: 11733 - RNA, 1617 nt, Artificial Sequence
  derived and/or modified sequence opt1 from VP1__Norovirus_and/or_Norovirus-like__KX353966
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccagaucaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgacgacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagcgccucuucaccggccccagcuccgccuucguggugcagccgcagaacgggcggugcacgaccgacggcguccugcuggggaccacccagcucagccccgugaacaucugcacguuccgcggcgacgucaaccacaucgccggcucccggaacuacaccaugaaccuggccagccugaacuggaacaacuacgaccccaccgaggagaccccggcgccccucgggacgcccgacuucgugggcaagauccagggggugcugacccagaccacccgcggcaacggguccacgcggggccaccgcgccaccgucuacaccggcagcgccgacuucacccccaagcuggggcggauccaguucgccacggacaccgacaacgacuucgagacccaccagaacaccaaguucacgccggugggcgugauccaggacgggaacaccacccaccgcaacgagccccagcaguggguccuccccagcuacuccggccggaacgugcagaacgugcaccuggcccccgcggucgccccgaacuuccccggggagcagcuccuguucuuccgcagcaccaugcccggcugcuccggcuaccccaacauggaccuggacugccugcucccgcaggagugggugcagcacuucuaccaggaggccgcccccgcgcagagcgacguggcccugcugcgguucgucaaccccgacacggggcgcguccucuucgagugcaagcugcacaaguccggcuucgugaccguggcccacaccgggcagcacgaccuggugaucccgcccaacggcuacuuccgcuucgacagcugggugaaccaguucuacacccucgcccccauggggaagggcaccggccggcgccgguga

SEQ ID NO: 11734 - RNA, 1617 nt, Artificial Sequence
  derived and/or modified sequence opt1 from VP1__Norovirus_and/or_Norovirus-like__AB663684
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11735 - RNA, 1617 nt, Artificial Sequence
  derived and/or modified sequence opt1 from VP1__Norovirus_and/or_Norovirus-like__KR904209
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccacaacuacaccaugaaccuggccucccagaacuggaacagcuacgacccgaccgaggagauccccgcgccccuggggacgcccgacuucgugggcaagauccaggggguccucacccagaccacccgcgccgacggcagcacgcgggggcacaaggccaccguguacaccggcuccgccgacuucagcccgaagcugggccgcgugcaguucgccaccgacacgaacaacgacuucgacgccaaccagaacaccaaguucacccccgucggggugauccaggacggcgagaccgcgcaccggaacgagccccagcagugggugcugcccuccuacagcgggcgcaacauccacaacguccaccucgccccggccguggcccccacguuccccggcgagcagcugcuguucuuccgguccaccaugcccgggugcagcggcuacccgaacauggagcucgacugccugaucccccaggagugggugcaguacuucuaccaggaggcggcccccgcccaguccgacgucgcccugcuccgcuucgugaaccccgacaccggccgggugcuguucgagugcaagcugcacaagagcggguacgucaccguggcccacacgggccagcacgaccucgugaucccgcccaacggguacuuccgcuucgacuccugggucaaccaguucuacacccuggcgcccaugggcaacgggaccggccggcgccgcuga

SEQ ID NO: 11736 - RNA, 1617 nt, Artificial Sequence
  derived and/or modified sequence opt1 from VP1__Norovirus_and/or_Norovirus-like__AB933716
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggaggugccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggagcaccacccaccgcaacgagccccagcaguggguccuccccuccuacagcggccgggacgugccgaacgugcaccuggcccccgccgucgcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacguggcgcugcugcgguucgucaacccggacaccgggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgccggcgcuga

SEQ ID NO: 11737 - RNA, 1617 nt, Artificial Sequence
  derived and/or modified sequence opt1 from VP1__Norovirus_and/or_Norovirus-like__AB933666
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccaggacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11738 - RNA, 1617 nt, Artificial Sequence
  derived and/or modified sequence opt1 from VP1__Norovirus_and/or_Norovirus-like__EU921349
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcggcgcgacggcuccacccgggggcacaaggccaccgugagcaccggcagcgugcacuucacgccgaagcugggccgcauccaguucuccaccgacaccagcaacgacuucgagaccgggcagaacacgcgguucacccccgucggcguggugcaggacggguccaccacccaccagaacgagccccagcaguggguccugcccgacuacagcggccgcgacucccacaacgugcaccucgccccggccguggcccccagcuuccccggggagcagcugcuguucuuccgguccacgaugcccggcugcagcggcuacccgaacaugaaccucgacugccugcugccccaggaguggguccagcacuucuaccaggaggccgcgcccgcccaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcgcccauggggaacggcacgggccgccggcgcuga

SEQ ID NO: 11739 - RNA, 1617 nt, Artificial Sequence
  derived and/or modified sequence opt1 from VP1__Norovirus_and/or_Norovirus-like__EU921348
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcggcgcgacggcuccacccgggggcacaaggccaccgugagcaccggcagcgugaacuucacgccgaagcugggccgcauccaguucuccaccgacaccagcaacgacuucgagaccgggcagaacacgcgguucacccccgucggcguggugcaggacggguccaccacccaccagaacgagccccagcaguggguccugcccgacuacagcggccgcgacucccacaacgugcaccucgccccggccguggcccccagcuuccccggggagcagcugcuguucuuccgguccacgaugcccggcugcagcggcuacccgaacaugaaccucgacugccugcugccccaggaguggguccagcacuucuaccaggaggccgcgcccgcccaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcgcccauggggaacggcacgggccgccggcgcuga

SEQ ID NO: 11740 - RNA, 1617 nt, Artificial Sequence
  derived and/or modified sequence opt1 from VP1__Norovirus_and/or_Norovirus-like__EU921345
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcggcgcgacggcuccacccgggggcacaaggccaccgugagcaccggcagcgugcacuucacgccgaagcugggccgcauccaguucuccaccgacaccagcaacgacuucgagaccgggcagaacacgcgguucacccccgucggcguggugcaggacggguccaccacccaccagaacgagccccagcaguggguccugcccgacuacagcggccgcgacgggcacaacgugcaccucgccccggccguggcccccuccuuccccggcgagcagcugcuguucuuccggagcacgaugcccggcugcuccggguacccgaacaugaaccucgacugccugcugccccaggaguggguccagcacuucuaccaggaggccgcgcccgcccagagcgacguggcccuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccaguucuacacccuggcgcccaugggcaacggcacggggcgccggcgcuga

SEQ ID NO: 11741 - RNA, 1617 nt, Artificial Sequence
  derived and/or modified sequence opt1 from VP1__Norovirus_and/or_Norovirus-like__KP698924
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggauccccgacuucgugggcaagauccaggggguccucacgcagaccacccgcaccgacggcagcacgcgggggcacaaggccaccguguacaccggcuccgccgacuucgccccgaagcugggccgcgugcaguucgagaccgacacgaaccacgacuucgaggccaaccagaacaccaaguucacccccgucggggugauccaggacggcgggaccacgcaccggaacgagccccagcagugggugcugcccagcuacuccggccgcaacaccccgaacguccaccucgcccccgcgguggcccccaccuuccccggggagcagcugcuguucuuccggagcaccaugccgggcugcuccggcuaccccaacauggaccucgacugccugcugccccaggagugggugcagcacuucuaccaggaggccgcccccgcgcagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcaccggccggcgccgcuga

SEQ ID NO: 11742 - RNA, 1617 nt, Artificial Sequence
  derived and/or modified sequence opt1 from VP1__Norovirus_and/or_Norovirus-like__LC005707
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgaccaggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcaccggccgccggcgcuga

SEQ ID NO: 11743 - RNA, 1617 nt, Artificial Sequence
  derived and/or modified sequence opt1 from VP1__Norovirus_and/or_Norovirus-like__KJ541743
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11744 - RNA, 1617 nt, Artificial Sequence
  derived and/or modified sequence opt1 from VP1__Norovirus_and/or_Norovirus-like__KF177443
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgggacggacaccgaccacgacuucgaggccaaccagaacaccaaguucacccccgucggcgugauccaggacggguccacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 11745 - RNA, 1617 nt, Artificial Sequence
  derived and/or modified sequence opt1 from VP1__Norovirus_and/or_Norovirus-like__JX439842
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcguguacaccaugaaccuggccucccugaacuggaacaacuacgaccccaccgaggagaucccggcgccccucgggacgcccgacuucgucggcaagauccagggggugcugacccagaccaccaaggaggacggcagcacgcgggggcacaaggccaccguguacaccggcagcgcccccuucaccccgaagcugggcuccguccaguucagcacggacaccgagaacgacuucgagacccaccagaacaccaaguucacgcccgugggggugauccaggacggcgggaccacccaccgcaacgagccccagcaguggguccuccccuccuacagcggccggaacgccccgaacgugcaccuggcccccgcgguggcccccaccuuccccggggagcagcuccucuucuuccgcuccacgaugccgggcugcagcggcuaccccaacauggaccuggacugccugcucccccaggaguggguccagcacuucuaccaggaggccgcccccgcgcaguccgacguggcccugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11746 - RNA, 1617 nt, Artificial Sequence
  derived and/or modified sequence opt1 from VP1__Norovirus_and/or_Norovirus-like__HF952135
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccgcccagaacuggaacagcuacgacccgaccgaggagauccccgcgccccuggggacgcccgacuucgucggcaagauccagggggugcucacccagaccaccaagacgaacggcuccacccgggggcacaaggccaccguguacaccggcagcgccgacuucuccccgaagcugggccgcguccaguucgccacggacaccgacaacgacuucgagaccaaccagaacaccaaguucacgcccgugggggugauccaggacggcagcaccacgccccggaacgagccccagcaguggguccugccguccuacagcgggcgcaacacccacaacgugcaccucgcccccgccguggcgcccaccuuccccggcgagcagcugcuguucuuccgguccaccaugccggggugcagcggcuaccccaacauggaccucgacugccugcugccccaggaguggguccaguacuucuaccaggaggccgcccccgcccaguccgacguggcgcuccugcgcuucgugaacccggacaccggccggguccuguucgagugcaagcuccacaagagcggguacgugaccguggcccacaccggccagcacgaccuggucaucccgcccaacggguacuuccgcuucgacuccugggugaaccaguucuacacgcuggcccccaugggcaacgggaccggccggcgccgcuga

SEQ ID NO: 11747 - RNA, 1617 nt, Artificial Sequence
  derived and/or modified sequence opt1 from VP1__Norovirus_and/or_Norovirus-like__JX459598
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccuguggcacgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgccuucgugguccagccccagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggcaagauccaggggguccucacccagacgacccgccgggacggcuccacccgcgggcacaaggccaccgugagcacgggcuccauccacuucaccccgaagcugggcagcgugcaguucagcaccgacaccuccaacgacuucgagacggggcagaacacccgguucacccccgucggcguggugcaggacgggagcaccacgcaccagaacgagccccagcaguggguccugcccaacuacuccggccgcgacagccacaacgugcaccucgccccggccguggcccccaccuuccccggggagcagcugcuguucuuccgguccaccaugcccggcugcagcggcuacccgaacaugaaccucgacugccugcugccccaggaguggguccagcacuucuaccaggaguccgcccccgcgcagagcgacguggcccuccugcgcuucgugaaccccgacaccgggcggguccuguucgagugcaagcuccacaaguccggcuacgugaccguggcccacacggggcagcacgaccuggucaucccgcccaacggcuacuuccgcuucgacagcugggugaaccaguucuacacccuggcccccauggggaacggcgcgggccggcgccgcuga

SEQ ID NO: 11748 - RNA, 1617 nt, Artificial Sequence
  derived and/or modified sequence opt1 from VP1__Norovirus_and/or_Norovirus-like__JX445162
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccugaucaucccgcccaacggguacuuccgguucgacagcugggucaaccaguucuacacccucgcccccaugggcaacggcacggggcgccggcgcuga

SEQ ID NO: 11749 - RNA, 1617 nt, Artificial Sequence
  derived and/or modified sequence opt1 from VP1__Norovirus_and/or_Norovirus-like__JX445154
augaagauggccagcaacgacgccacccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagccgggcuacgugaccgucgcccacacggggcagcacgaccuggugaucccgcccaacggcuacuuccgcuucgacagcugggugaaccaguucuacacccuggcccccauggggaacggcgcgggccggcgccgcuga

SEQ ID NO: 11750 - RNA, 1617 nt, Artificial Sequence
  derived and/or modified sequence opt1 from VP1__Norovirus_and/or_Norovirus-like__JX155752
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccacaacuacgccaugaaccuggcgagccugaacuggaacaacuacgaccccaccgaggagaucccggcgccccucgggacccccgacuucgugggcaagauccaggggguccugacgcagaccaccaagggcgacggguccacccgcggccacaaggccacgaucuacaccggcagcgcccccuucaccccgaagcuggggagcgugcaguucuccaccgacacggagaacgacuucgagacccaccagaacaccaaguucacccccgugggcgucauccaggacgggggcacgacccaccggaacgagccccagcagugggugcuccccagcuacuccgggcgcaacgugccgaacguccaccuggcccccgccguggcccccaccuuccccggcgagcagcuccucuucuuccggagcaccaugccgggcugcuccggguaccccaacauggaccuggacugccugcucccccaggagugggugcagcacuucuaccaggaggccgcccccgcgcagagcgacgucgcccugcugcgcuucgugaacccggacacgggccggguccucuucgagugcaagcugcacaaguccggguaccugaccguggcccacaccggccagcacgaccucgugaucccgcccaacggguacuuccgcuucgacagcugggugaaccaguucuacacccuggcccccaugggcaacggcaccgggcggcgccgguga

SEQ ID NO: 11751 - RNA, 1617 nt, Artificial Sequence
  derived and/or modified sequence opt1 from VP1__Norovirus_and/or_Norovirus-like__HM748971
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggcccuccccuccuacagcgggcggaacgugcagaacguccaccuggccccggcgguggcccccaccuuccccggcgagcagcuccucuucuuccgcuccacgaugcccggcugcagcggguacccgaacauggaccuggacugccugcucccccaggagugggugcagcacuucuaccaggaggccgcccccgcgcaguccgacgucgcccugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 11752 - RNA, 1617 nt, Artificial Sequence
  derived and/or modified sequence opt1 from VP1__Norovirus_and/or_Norovirus-like__GQ845367
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggacaugaaccccuaccucagccaccuggcccgcauguacaacggcuacgccgggggcuucgaggugcaggucauccuggccgggaacgccuucacggcgggcaagaucaucuucgccgccgugccgcccaacuucccgaccgaggggcucucccccagccaggugaccauguucccccacaucaucgucgacgugcggcagcuggagcccgugcugaucccgcuccccgacguccgcaacaacuucuaccacuacaaccaguccaacgaccccaccaucaagcugaucgccaugcuguacacgccccuccgggccaacaacgcgggcgacgacguguucaccgugagcugccgcguccugacccggccgucccccgacuucgacuucaucuuccuggugccgcccaccguggagagccgcacgaagcccuucuccguccccauccucaccguggaggagaugaccaacagccgguuccccaucccccuggagaagcuguucaccggcccguccagcgccuucgugguccagccccagaacgggcgcugcacgaccgacggcgugcuccuggggaccacccagcugucccccgucaacaucugcacguuccggggcgacgugacccacaucgccggcagccgcaacuacaccaugaaccucgccucccagaacuggaacagcuacgacccgaccgaggagauccccgcgccccuggggacgcccgacuucgugggcaagauccaggggguccugacccagaccacccggacggacggcagcacccgcgggcacaaggccaccguguacaccggcuccgccgacuucagcccgaagcucggccgggugcaguucgccacggacaccgacaacgacuucgacgccaaccagaacaccaaguucacccccgucggggugauccaggacggcaacacggcccaccgcaacgagccccagcagugggugcugcccuccuacagcgggcggaacacccacaacguccaccuggcgccggccguggcccccaccuuccccggcgagcagcuccuguucuuccgcuccaccaugcccgggugcagcggcuacccgaacauggaccuggacugccuccugccccaggagugggugcaguacuucuaccaggaggccgcgcccgcccaguccgacgucgcccugcuccgguucgugaaccccgacacgggccgcgugcuguucgagugcaagcugcacaagagcggguacgucaccguggcccacaccggccagcacgaccucgugaucccgcccaacggguacuuccgguucgacuccugggucaaccaguucuacacccuggcccccaugggcaacgggaccggccgccgccgguga

SEQ ID NO: 11753 - RNA, 1617 nt, Artificial Sequence
  derived and/or modified sequence opt1 from VP1__Norovirus_and/or_Norovirus-like__GQ856455
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagcccaacgacagcaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcacggccacaaggccaccguguacaccggcuccgccccguucacccccaagcuggggagcgugcaguucagcacggacaccgagaacgacuucgagacccaccagaacaccaaguucacgcccgucggcgugauccaggacggguccaccacccaccggaacgagccccagcagugggugcucccgagcuacuccggccgcaacguccagaacgugcaccuggcccccgccguggcgcccaccuuccccggggagcagcuccucuucuuccggagcacgaugccgggcugcuccggcuaccccaacauggaccuggacugccugcucccccaggaguggguccagcacuucuaccaggaggccgcccccgcccagagcgacguggcgcugcugcgcuucgugaacccggacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccauggggaacggcacgggccggcgccgguga

SEQ ID NO: 11754 - RNA, 1617 nt, Artificial Sequence
  derived and/or modified sequence opt1 from VP1__Norovirus_and/or_Norovirus-like__GQ856447
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccaaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11755 - RNA, 1617 nt, Artificial Sequence
  derived and/or modified sequence opt1 from VP1__Norovirus_and/or_Norovirus-like__AB541318
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgguga

SEQ ID NO: 11756 - RNA, 1617 nt, Artificial Sequence
  derived and/or modified sequence opt1 from VP1__Norovirus_and/or_Norovirus-like__AB541307
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaagcccggguacgugaccguggcccacaccggccagcacgaccuggucauccccuccaacggguacuuccgguucgacagcugggugaaccaguucuacacccucgcccccaugggcaacggcacggggcgccggcgcuga

SEQ ID NO: 11757 - RNA, 1617 nt, Artificial Sequence
  derived and/or modified sequence opt1 from VP1__Norovirus_and/or_Norovirus-like__AB541254
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucgucaaggcccccgggggcgaguucaccgugagcccccggaacucccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucaucgugcagccgcagaacgggcgcugcacgaccgacggcguccugcuggggaccacccagcucucccccgugaacaucugcacguuccggggcgacgucacccacaucgccggcagccgcaacuacaccaugaaccuggccucccugaacuggaacaacuacgaccccaccgaggaggugccggcgccccucgggacgcccgacuucgugggcaagauccaggggguccugacccagaccaccaagggcgacgggagcacgcggggccacaaggccaccguguacaccggcagcgccgacuucacccccaagcugggguccgugcaguucggcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaacuuccccggcgagcagcuccucuucuuccgcuccaccaugcccggcugcagcggguaccccaacauggaccuggacugccugcucccgcaggaguggguccagcacuucuaccaggaggcggcccccgcccaguccgacguggcccugcugcgguucgugaaccccgacacgggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacggcaccgggcgccggcgcuga

SEQ ID NO: 11758 - RNA, 1617 nt, Artificial Sequence
  derived and/or modified sequence opt1 from VP1__Norovirus_and/or_Norovirus-like__AB541243
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccccugguccgccccgcugggccccgaccugaaccccuaccucucccaccuggcccgcauguacaacggcuacgccgggggcuucgaggugcaggucauccuggccgggaacgcguucaccgccggcaagaucaucuucgccgccgugcccccgaacuuccccacggaggggcucagccccucccaggugaccauguucccccacaucaucgucgacgugcggcagcuggagccggugcugaucccccuccccgacguccgcaacaacuucuaccacuacaaccagagcaacgacuccaccaucaagcugaucgccaugcuguacacgccccuccgggcgaacaacgccggcgaggacguguucaccgugagcugccgcguccugacccggccgucccccgacuucgacuucaucuuccuggugccgcccaccguggagagccgcaccaagccguucacgguccccauccucaccguggaggagaugaccaacucccgguuccccaucccccuggagaagcuguucaccggcccgagcuccgccuucgugguccagccccagaacgggcgcugcacgaccgacggcgugcuccuggggaccacccagcugagccccgucaacaucugcacguuccggggcgacgugacccacaucgccggcucccgcgacuacaccaugaaccucgccagccugaacuggaacaacuacgacccgaccgaggagauccccgcgccccuggggacgcccgacuucgugggcaagauccaggggguccucacccagaccaccaagggcgacggguccacgcggggccacaaggccaccguguacaccggcagcgccccguucacccccaagcuggggagcgugcgcuucuccacggacaccgagaacgacuucgagacccaccagaacaccaaguucacgcccgucggcgugauccaggacgggagcaccacccaccggaacgagccccagcagugggugcugccguccuacagcggccgcgacguccacaacgugcaccucgcccccgccguggcgcccaccuuccccggggagcagcugcuguucuuccgguccacgaugccgggcugcagcggcuaccccaacauggaccucgacugccugcugccccaggaguggguccagcacuucuaccaggaggccgcccccgcccaguccgacguggcgcuccugcgcuucgugaacccggacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcccccauggggaacggcacgggccggcgccgcuga

SEQ ID NO: 11759 - RNA, 1617 nt, Artificial Sequence
  derived and/or modified sequence opt1 from VP1__Norovirus_and/or_Norovirus-like__AB541232
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccacccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccagaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacgcucgcccccaugggcaacggcaccgggcgccggcgcuga

SEQ ID NO: 11760 - RNA, 1617 nt, Artificial Sequence
  derived and/or modified sequence opt1 from VP1__Norovirus_and/or_Norovirus-like__GQ246800
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccccgugcccccgaccguggagucccgcacgaagcccuucaccguccccauccucaccguggaggagaugaccaacagccgguuccccaucccgcuggagcgccuguacacgggccccuccagcgccuucgugguccagccccagaacgggcggugcaccaccgacggcgugcuccuggggaccacgcagcuguccgccgucaacaucugcaccuuccgcggcgacgugacccacaucgccggcagccggaacuacaccaugaaccucgccucccagaacuggaacaacuacgacccgacggaggagauccccgcgccccuggggacccccgacuucgugggcaagauccaggggaugcugacccagaccacgcgcagcgacggcuccacccgggggcacaaggccaccguccucaccggcagcgccgacuucgccccgaagcugggccgcgugcaguucgccacggacaccgacaacgacuucgagagcgggcagaacaccaaguucacccccgugggcgucauccaggacggguccacgacccaccggaacgagccccagcagugggugcugcccaacuacagcggccgcaccgggcacaacgugcaccucgcgccggccgucgcccccaccuaccccggcgagcagcugcuguucuuccgguccacgaugcccggcugcagcggguacccgaacauggaccucgacugccugcugccccaggagugggugcagcacuucuaccaggaggccgcgcccgcccaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacggcacggggcgccggcgcuga

SEQ ID NO: 11761 - RNA, 1617 nt, Artificial Sequence
  derived and/or modified sequence opt1 from VP1__Norovirus_and/or_Norovirus-like__GU390900
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcuccgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacguccagaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11762 - RNA, 1617 nt, Artificial Sequence
  derived and/or modified sequence opt1 from VP1__Norovirus_and/or_Norovirus-like__AB504328
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccugaccucccugaacuggaacaacuacgaccccacggaggagaucccggcgccccucggcacccccgacuucguggggaagauccagggccugcugacccagaccacgaagggggacggcagcacccggggccacaaggccaccgucuacaccggguccgcccccuucacgccgaagcucggcagcgugcaguucagcaccgacaccgagaacgacuucgagacccaccagaacacgaaguucacccccgugggggucauccaggacggcuccaccacccaccgcaacgagccccagcagugggugcugcccagcuacuccgggaucaacgugcacaacguccaccuggccccggccguggcccccacguuccccggcgagcagcuccuguucuuccggagcaccaugcccggcugcuccggguacccgaacauggaccuggacugccuccugccccaggagugggugcagcacuucuaccaggaggcggcccccgcccagagcgacgucgcccugcuccgcuucgugaaccccgacaccggccgggugcuguucgagugcaagcugcacaaguccggguacgucaccguggcgcacaccggccagcacgaccucgugaucccgcccaacggguacuuccgcuucgacagcugggucaaccaguucuacacgcuggcccccaugggcaacggcaccgggcggcgccgguga

SEQ ID NO: 11763 - RNA, 1617 nt, Artificial Sequence
  derived and/or modified sequence opt1 from VP1__Norovirus_and/or_Norovirus-like__AB447434
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacagcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggggaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcggggccacaaggccaccguguacaccggcuccgccccguucacccccaagcuggggagcgugcaguucagcacggacaccgagaacgacuucgagacccaccagaacaccaaguucacgcccgucggcgugauccaggacggguccaccacccaccgcaacgagccccagcagugggugcucccgagcuacuccggccggaacguccacaacgugcaccuggcccccgccguggcgcccaccuuccccggggagcagcuccucuucuuccgcagcacgaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11764 - RNA, 1617 nt, Artificial Sequence
  derived and/or modified sequence opt1 from VP1__Norovirus_and/or_Norovirus-like__EU839591
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccgcgggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccggaacgagccccagcagugggugcuccccagcuacuccgggcgcaacgucccgaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcuga

SEQ ID NO: 11765 - RNA, 1617 nt, Artificial Sequence
  derived and/or modified sequence opt1 from VP1__Norovirus_and/or_Norovirus-like__AB291542
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggccacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcuga

SEQ ID NO: 11766 - RNA, 1617 nt, Artificial Sequence
  derived and/or modified sequence opt1 from VP1__Norovirus_and/or_Norovirus-like__KX354123
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagcgccucuucaccggcccguccagcgccuucgucgugcagccccagaacgggcggugcaccacggacggcgugcugcuggggaccacccagcucucccccgucaacaucugcaccuuccgcggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccacccuguacaccggcagcgccgaguucgccccgaagcugggccgggugcaguucgagacggacaccaaccacgacuucgaggccaaccagaacaccaaguucacccccgugggggucauccaggacggcuccacgacccaccgcaacgagccccagcagugggugcuccccaccuacagcgggcggaacacccacaacgugcaccuggccccggcggucgcccccacguuccccggcgagcagcuccuguucuuccgcuccaccaugcccgggugcagcggcuacccgaacauggaccuggacugccugcucccccaggagugggugcagcacuucuaccaggaggccgcccccgcgcaguccgacguggcccugcugcgguucgucaaccccgacaccggccgcguccucuucgagugcaagcugcacaagagcggguacaucaccguggcccacaccggccagcacgaccuggugaucccgcccaacggguacuuccgguucgacuccugggugaaccaguucuacacgcucgcccccaugggcaacgggaccggccgccgccgguga

SEQ ID NO: 11767 - RNA, 1617 nt, Artificial Sequence
  derived and/or modified sequence opt1 from VP1__Norovirus_and/or_Norovirus-like__KX354050
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggccucgaggugcaggucauccuggccgggaacgccuucaccgccggcaagaucaucuucgccgccgugccgcccaacuucccgacggaggggcugucccccagccaggugaccauguucccccacaucaucgucgacgugcggcagcucgagcccgugcugaucccgcugcccgacguccgcaacaacuucuaccacuacaaccaguccaacgaccccaccaucaagcucaucgccaugcuguacacgccccugcgggcgaacaacgccggcgacgacguguucaccgugagcugccgcguccucacccggccgucccccgacuucgacuucaucuuccuggugccgcccaccguggagagccgcaccaagcccuucuccguccccauccugacgguggaggagaugaccaacagccgguuccccaucccccucgagaagcuguucaccggcccguccagcgccuucgugguccagccccagaacgggcgcugcaccacggacggcgugcugcucgggaccacccagcugucccccgucaacaucugcaccuuccggggcgacgugacgcacaucaccggcagccgcaacuacaccaugaaccuggccucccagaacuggaacaacuacgacccgaccgaggagauccccgcgccccucgggacgcccgacuucgugggcaagauccaggggguccugacccagaccacccgggccgacggcagcacgcgcgggcacaaggccaccguguacaccggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcuccccuccuacagcggccggaacacccacaacguccaccuggcgccggccguggcccccaccuuccccggggagcagcuccucuucuuccgcuccaccaugcccggcugcagcggcuacccgaacauggaccuggacugccugcucccccaggagugggugcaguacuucuaccaggaggccgcgcccgcccaguccgacgucgcccugcugcgguucgugaaccccgacacggggcgcgugcuguucgagugcaagcugcacaagagcggcuacgucaccguggcccacaccgggcagcacgaccuggugaucccgcccaacggcuacuuccgguucgacuccugggucaaccaguucuacacccucgcccccauggggaacggcaccggccgccgccgguga

SEQ ID NO: 11768 - RNA, 1617 nt, Artificial Sequence
  derived and/or modified sequence opt1 from VP1__Norovirus_and/or_Norovirus-like__AB933717
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcgggacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11769 - RNA, 1617 nt, Artificial Sequence
  derived and/or modified sequence opt1 from VP1__Norovirus_and/or_Norovirus-like__AB933707
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcgcccccuucaccccgaagcugggguccgugcaguucagcacggacaccgagaacgacuucgagacccaccagaacaccaaguucacgcccgugggcgucauccaggacggguccaccacccaccgcaacgagccccagcagugggugcuccccagcuacuccggccggaacgugccgaacguccaccuggcccccgccguggcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacgucgcgcugcugcgguucgugaacccggacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcuga

SEQ ID NO: 11770 - RNA, 1617 nt, Artificial Sequence
  derived and/or modified sequence opt1 from VP1__Norovirus_and/or_Norovirus-like__AB933705
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagacccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggaugcugacccagaccacgaagggcgacggguccacccggggccacaaggccaccgucuacaccggcagcgcccccuucacgccgaagcuggggagcgugcaguucuccaccgacaccgagaacgacuucgagacccaccagaacacgaaguucacccccgugggcgucauccaggacgggagcaccacccaccgcaacgagccccagcagugggugcuccccuccuacagcggccggaacgugccgaacguccaccuggcccccgccguggcgcccacguuccccggggagcagcuccucuucuuccgcuccaccaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccauggggaacggcaccggccgccggcgcuga

SEQ ID NO: 11771 - RNA, 1617 nt, Artificial Sequence
  derived and/or modified sequence opt1 from VP1__Norovirus_and/or_Norovirus-like__AB933704
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccaguacgaccuggucaucccgcccaacggguacuuccgguucgacagcugggugaaccaguucuacacccucgcccccaugggcaacggcacggggcgccggcgcuga

SEQ ID NO: 11772 - RNA, 1617 nt, Artificial Sequence
  derived and/or modified sequence opt1 from VP1__Norovirus_and/or_Norovirus-like__AB933699
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagcugaacgacagcaccaucaagcucaucgccaugcuguacacgccccugcgggcgaacaacgccggcgaggacguguucaccguguccugccgcguccucacccggcccagcccggacuucgacuucaucuuccuggugccgcccaccguggagucccgcaccaagcccuucaccguccccauccugacgguggaggagaugaccaacagccgguuccccaucccccucgagaagcuguucaccggccccuccagcgccuucgugguccagccgcagaacgggcgcugcaccacggacggcgugcugcucgggaccacccagcugucccccgucaacaucugcaccuuccggggcgacgugacgcacaucgccggcagccgcaacuacaccaugucccuggccagccucaacuggaacaacuacgaccccaccgaggagaucccggcgccccuggggacccccgacuucgugggcaagauccaggggguccugacgcagaccaccaagggcgacggguccacccggggccacaaggccacgguguacaccggcagcgcccccuucaccccgaagcucgggagcgugcaguucuccaccgacacggagaacgacuucgagacccaccagaacaccaaguucacccccgucggcgugauccaggacgggggcacgacccaccgcaacgagccccagcagugggugcugcccagcuacuccgggcggaacgucccgaacgugcaccuggcccccgccguggcgcccaccuuccccggcgagcagcuccuguucuuccgcagcaccaugccgggcugcuccggguaccccaacauggaccuggacugccuccugccccaggaguggguccagcacuucuaccaggaggccgcccccgcccagagcgacguggcgcugcuccgguucgugaacccggacacgggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcaccgggcgccggcgcuga

SEQ ID NO: 11773 - RNA, 1617 nt, Artificial Sequence
  derived and/or modified sequence opt1 from VP1__Norovirus_and/or_Norovirus-like__AB933679
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucaucgugcagccgcagaacgggcgcugcacgaccgacggcguccugcuggggaccacccagcucagccccgugaacaucugcacguuccggggcgacgucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcggaacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11774 - RNA, 1617 nt, Artificial Sequence
  derived and/or modified sequence opt1 from VP1__Norovirus_and/or_Norovirus-like__AB933661
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgagccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcccccaccuuccccggcgagcagcuccucuucuuccgcagcacgaugccgggcugcuccggguaccccaacauggaccuggacugccugcucccccaggaguggguccagcacuucuaccaggaggcggcccccgcccagagcgacguggcccugcugcgguucgugaacccggacaccggccgcguccucuucgagugcaagcugcacaaguccggguacgugaccguggcgcacaccggccagcacgaccuggucaucccgcccaacggguacuuccgguucgacagcugggugaaccaguucuacacccucgcccccaugggcaacggcacggggcgccggcgcuga

SEQ ID NO: 11775 - RNA, 1617 nt, Artificial Sequence
  derived and/or modified sequence opt1 from VP1__Norovirus_and/or_Norovirus-like__KT152148
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11776 - RNA, 1617 nt, Artificial Sequence
  derived and/or modified sequence opt1 from VP1__Norovirus_and/or_Norovirus-like__EU921393
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccacaacuacaccaugaaccuggccagccugaacuggaacaacuacgaccccaccgaggagaucccggcgccccucggcacgcccgacuucguggggaagauccagggcguccugacccagaccaccaagggggacggcuccacgcgcggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccggaacgagccccagcagugggugcuccccuccuacagcggguccaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11777 - RNA, 1617 nt, Artificial Sequence
  derived and/or modified sequence opt1 from VP1__Norovirus_and/or_Norovirus-like__KM396961
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccacaacuacaccaugaaccuggccucccagaacuggagcaacuacgacccgacggaggagauccccgcgccccuggggacccccgacuucgugggcaagauccaggggguccucacccagaccacgcgcaccgacggcagcacccgggggcacaaggccaccgugcgcacgggcuccgccgacuucgccccgaagcugggccgggugcaguucgagaccgacaccgaccacgacuucgaggccaaccagaacaccaaguucacgcccgucggggugauccaggacggcagcaccacccaccgcaacgagccccagcagugggugcugcccuccuacagcgggcggaacaccccgaacguccaccucgcccccgcgguggcccccacguuccccggcgagcagcugcuguucuuccgcuccaccaugccggggugcagcggcuaccccaacauggaccucgacugccugcugccccaggagugggugcagcacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgguga

SEQ ID NO: 11778 - RNA, 1617 nt, Artificial Sequence
  derived and/or modified sequence opt1 from VP1__Norovirus_and/or_Norovirus-like__KM198485
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagaccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacaucgccggcagccgcaacuacaccaugaaccuggccucccugaacuggaacaacuacgaccccacggaggagaucccggcgccccucgggacccccgacuucgugggcaagauccaggggguccugacccagaccacgaagggcgacgggagcacccggggccacaaggccaccguguacaccggcuccgcccccuucacgccgaagcuggggagcgugcaguucagcaccgacaccgagaacgacuucgagacccaccagaacacgaaguucacccccgucggcgugauccaggacgggggcaccacccaccgcaacgagccccagcagugggugcuccccuccuacagcgggcggaacguccacaacgugcaccuggccccggccguggcgcccacguuccccggcgagcagcuccucuucuuccgcuccaccaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacgcucgcccccaugggcaacggcaccgggcgccggcgcuga

SEQ ID NO: 11779 - RNA, 1617 nt, Artificial Sequence
  derived and/or modified sequence opt1 from VP1__Norovirus_and/or_Norovirus-like__KF306214
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggguccucacgcagaccacccggaccgacggcagcacgcgcgggcacaaggccaccguguacaccggcagcgccgacuucgccccgaagcugggccgggugcaguucgagaccgacacggaccacgacuucgaggucaaccagaacaccaaguucacccccgugggggugauccaggacggcgggaccacgcaccgcaacgagccccagcaguggguccugcccuccuacagcggccggaacaccccgaacgugcaccucgcccccgcgguggcccccaccuuccccggggagcagcugcuguucuuccgcuccaccaugccgggcugcagcggcuaccccaacauggaccucgacugccugcugccccaggaguggguccaguacuucuaccaggaggccgcccccgcgcaguccgacguggcccuccugcgguucgugaacccggacacggggcgcguccuguucgagugcaagcuccacaagagcggcuacgugaccguggcccacaacgggcagcacgaccuggucaucccgcccaacggcuacuuccgguucgacuccugggugaaccaguucuacacccuggcccccauggggaacggcaccggccgccgccgguga

SEQ ID NO: 11780 - RNA, 1617 nt, Artificial Sequence
  derived and/or modified sequence opt1 from VP1__Norovirus_and/or_Norovirus-like__JX439831
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaucgacggcgugcuccuggggaccacccagcucucccccgucaacaucugcaccuuccggggcgacgugacgcacaucaccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgccaaccagaacaccaaguucacccccgucggggugauccaggacggcaacacggcgcaccgcaacgagccccagcagugggugcugcccuccuacagcgggcggaacucccacaacguccaccucgccccggccguggcccccaccuuccccggcgagcaguuccuguucuuccgcagcaccaugcccgggugcuccggcuacccgaacauggaccuggacugccuccugccccaggagugggugcaguacuucuaccaggaggcggcccccgcccagagcgacgucgcccugcuccgguucgugaaccccgacaccggccgcgugcuguucgagugcaagcugcacaaguccggguacgucacgguggcccacaccggccagcacgaccucgugaucccgcccaacggguacuuccgguucgacagcugggucaaccaguucuacacccuggcgcccaugggcaacgggaccggccgccgccgguga

SEQ ID NO: 11781 - RNA, 1617 nt, Artificial Sequence
  derived and/or modified sequence opt1 from VP1__Norovirus_and/or_Norovirus-like__KC409281
augaagauggccagcaacgacgccaaccccuccgacggcagcgcggccucccuggugcccgaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggggccuucgugguccagccccagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgacccgacggaggagauccccgcgccccucggcacccccgacuucguggggaagauccagggcguccugacccagaccacgaagggggacggcagcacccggggccacaaggccaccguguacaccggguccgccccguucacgcccaagcugggcagcgugcaguucagcaccgacaccgagaacgacuucgagacccaccagaacacgaaguucacccccgucggggugauccaggacggcgggaccacccaccgcaacgagccccagcagugggugcucccguccuacagcggccgggacguccacaacgugcaccuggcccccgccguggcgcccacguuccccggcgagcagcuccucuucuuccgcuccaccaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11782 - RNA, 1617 nt, Artificial Sequence
  derived and/or modified sequence opt1 from VP1__Norovirus_and/or_Norovirus-like__JX459639
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugcagaacguccaccuggccccggccguggcgcccaccuuccccggggagcagcuccucuucuuccgcuccacgaugcccggcugcagcggcuacccgaacauggaccuggacugccugcucccccaggagugggugcagcacuucuaccaggaggccgcccccgcccaguccgacgucgcgcugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcuga

SEQ ID NO: 11783 - RNA, 1617 nt, Artificial Sequence
  derived and/or modified sequence opt1 from VP1__Norovirus_and/or_Norovirus-like__JX459609
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgccgugcagccgcagaacggccgcugcacgaccgacgggguccugcugggcaccacccagcucucccccgugaacaucugcacguuccggggcgacgucacccacaucgccgggagccgcaacuacaccaugaaccuggcgucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgagacccaccagaacaccaaguucacgcccgugggggucauccaggacggcgggaccacccaccgcaacgagccccagcagugggugcuccccuccuacagcggccggaacgugcacaacguccaccuggccccggccguggcccccaccuuccccggcgagcagcuccucuucuuccgcuccacgaugcccgggugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgccaccguggcccacaccgggcagcacgaccuggugaucccgcccaacggcuacuuccgguucgacuccugggugaaccaguucuacacccucgcccccaugggcaacgggacgggccgccggcgcuga

SEQ ID NO: 11784 - RNA, 1617 nt, Artificial Sequence
  derived and/or modified sequence opt1 from VP1__Norovirus_and/or_Norovirus-like__JN400599
augaagauggccagcaacgacgccacccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgaccagccgcgacggcuccacccgggggcacaaggccaccgugagcacgggcagcgugcacuucaccccgaagcugggcuccguccaguucagcaccgacaccuccaacgacuucgagacggggcagaacacccgcuucacccccgugggcgugguccaggacgggagcaccacgcaccagaacgagccccagcagugggugcugcccaacuacuccggccgggacagccacaacgugcaccucgccccggccgucgcccccaccuuccccggggagcagcugcuguucuuccgcuccaccaugcccggcugcagcggcuacccgaacaugaaccucgacugccugcugccccaggagugggugcagcacuucuaccaggaguccgcccccgcgcagagcgacguggcccuccugcgguucgucaaccccgacaccgggcgcgugcuguucgagugcaagcuccacaagccgggcuacgugaccgucgcccacacggggcagcacgaccuggugaucccgcccaacggcuacuuccgguucgacuccugggugaaccaguucuacacccuggcccccauggggaacggcgcgggccgccggcgcuga

SEQ ID NO: 11785 - RNA, 1617 nt, Artificial Sequence
  derived and/or modified sequence opt1 from VP1__Norovirus_and/or_Norovirus-like__JQ613539
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccacaacuacaccaugaaccuggccucccagaacuggaacagcuacgacccgacggaggagauccccgcgccccuggggacccccgacuucgugggcaagauccaggggguccucacccagaccacgcgcaccgacggcagcacccgggggcacaaggccaccguguacacgggcuccgccgaguucagcccgaagcugggccgcgugcaguucgccaccgacaccaacaacgacuucgacgccaaccagaacaccaaguucacgcccgucggggugauccaggacggcgggaccacccaccggaacgagccccagcagugggugcugcccuccuacagcggccgcaacacccacaacguccaccucgccccggccguggcgcccacguuccccggggagcagcugcuguucuuccgguccaccaugcccggcugcagcggcuacccgaacauggaccucgacugccugaucccccaggagugggugcaguacuucuaccaggaggccgcccccgcccaguccgacgucgcgcugcuccgcuucgugaaccccgacaccgggcgggugcuguucgagugcaagcugcacaagagcggcuacgucaccguggcccacaccgggcagcacgaccucgugaucccgcccaacggcuacuuccgcuucgacuccugggucaaccaguucuacacgcuggcccccauggggaacggcaccggccggcgccgcuga

SEQ ID NO: 11786 - RNA, 1617 nt, Artificial Sequence
  derived and/or modified sequence opt1 from VP1__Norovirus_and/or_Norovirus-like__HQ456329
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuaccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggggcgcccccuucaccccgaagcugggguccgugcaguucagcacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11787 - RNA, 1617 nt, Artificial Sequence
  derived and/or modified sequence opt1 from VP1__Norovirus_and/or_Norovirus-like__HM802536
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcgcccccgacuucguggggaagauccagggcguccugacgcagaccaccaagggggacggcagcacccggggccacaaggccacgguguacaccggguccgcccccuucaccccgaagcugggcagcgugcaguucagcaccgacacggagaacgacuucgagacccaccagaacaccaaguucacccccgucggggugauccaggacggcuccacgacccaccgcaacgagccccagcagugggugcuccccagcuacuccgggcggaacguccacaacgugcaccuggccccggcgguggcccccaccuuccccggcgagcagcuccucuucuuccgcagcaccaugcccggcugcuccggguacccgaacauggaccuggacugccugcucccccaggaguggguccagcacuucuaccaggaggccgcccccgcgcagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11788 - RNA, 1617 nt, Artificial Sequence
  derived and/or modified sequence opt1 from VP1__Norovirus_and/or_Norovirus-like__HM802532
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugucccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11789 - RNA, 1617 nt, Artificial Sequence
  derived and/or modified sequence opt1 from VP1__Norovirus_and/or_Norovirus-like__AB541341
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggaacaccacccaccgcaacgagccccagcagugggugcuccccagcuacuccggccggaacgugcagaacguccaccuggccccggccguggcgcccaccuuccccggggagcagcuccucuucuuccgcagcacgaugcccggcugcuccggcuacccgaacauggaccuggacugccugcucccccaggagugggugcagcacuucuaccaggaggccgcccccgcccagagcgacgucgcgcugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcuga

SEQ ID NO: 11790 - RNA, 1617 nt, Artificial Sequence
  derived and/or modified sequence opt1 from VP1__Norovirus_and/or_Norovirus-like__AB541264
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccggcucccgcgacuacaccaugaaccuggccagccugaacuggaacaacuacgaccccaccgaggagaucccggcgccccucgggacgcccgacuucgucggcaagauccagggggugcugacccagaccacccggggcgacggguccacgcgcggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccggaacgagccccagcaguggguccuccccagcuacuccgggcgcaacgugccgaacgugcaccuggcccccgccgucgcgcccaccuuccccggcgagcagcuccucuucuuccggagcacgaugccgggcugcuccggguaccccaacauggaccuggacugccugcucccccaggagugggugcagcacuucuaccaggaggccgcccccgcccagagcgacguggcgcugcugcgcuucgucaacccggacaccggccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggcgccgcuga

SEQ ID NO: 11791 - RNA, 1617 nt, Artificial Sequence
  derived and/or modified sequence opt1 from VP1__Norovirus_and/or_Norovirus-like__AB541236
augaagauggccagcaacgacgccaaccccuccgacggcagcgcggccaaccuggugcaggaggucaacaacgaggugauggcccucgagccgguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccugggccccgaccucaacccguaccugucccaccuggcccgcauguacaacggcuacgccgggggcuucgaggugcaggucauccucgccgggaacgccuucaccgccggcaagaucaucuucgccgccgugccgcccaacuuccccacggaggggcugagccccucccaggugaccauguucccccacaucaucgucgacgugcggcagcuggagcccgugcucaucccccugccggacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccucccccgacuucgacuucaucuuccucgugccgcccaccguggagagccgcaccaagcccuucacgguccccauccugaccguggaggagaugaccaacucccgguucccgaucccccuggagaagcuguucaccggccccagcuccgccuucgugguccagccccagaacgggcgcugcacgaccgacggcgugcugcuggggaccacccagcucagcccggucaacaucugcacguuccggggcgacgugacccacaucgccggcucccgcaacuacaucaugaaccuggccagccugaacuggaacaacuacgaccccaccgaggagauccccgcgccgcucgggacccccgacuucgugggcaagauccaggggguccugacgcagaccaccaagggcgacggguccacccggggccacaaggccacgguguacaccggcagcgcccccuucacccccaagcuggggagcgugcaguucuccaccgacacggagaacgacuucgagacccaccagaacaccaaguucaccccggucggcgugauccaggacgggagcacgacccaccgcaacgagccccagcagugggugcuccccuccuacagcggcgggaacguccacaacgugcaccuggcccccgccguggcgccgaccuuccccggcgagcagcuccucuucuuccgguccaccaugcccggcugcagcggguaccccaacauggaccuggacugccugcucccgcaggaguggguccagcacuucuaccaggaggccgcccccgcccaguccgacguggcgcugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgguga

SEQ ID NO: 11792 - RNA, 1617 nt, Artificial Sequence
  derived and/or modified sequence opt1 from VP1__Norovirus_and/or_Norovirus-like__AB541208
augaagauggccagcaacgaccccucccccagcgacggcuccgccgcgaaccuggugcccgaggucaacaacgaggugauggcccucgagcccguggucggggccgccaucgccgcgcccguggccggccagcagaacgugaucgacccguggauccgcaacaacuucguccaggcccccgggggcgaguucaccgugagcccccggaacgcccccggggagauccugugguccgcgccgcugggccccgaccucaaccccuaccugagccaccuggcccgcauguacaacggcuacgccgggggcuucgaggugcaggucauccucgccgggaacgccuucaccgcgggcaagaucaucuucgccgccgugcccccgaacuuccccacggaggggcugucccccagccaggugaccauguucccccacaucaucgucgacgugcggcagcuggagccggugcucaucccccugcccgacguccgcaacaacuucuaccacuacaaccaguccaacgacagcaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcggggccacaaggccaccguguacaccggcagcgccccguucacccccaagcugggguccgugcaguucagcacggacaccgagaacgacuucgagacccaccagaacaccaaguucacgcccgucggcgugauccaggacgggggcaccacccaccgcaacgagccccagcagugggugcucccguccuacagcgggcgggacguccagaacgugcaccuggcccccgccguggcccccaccuuccccggcgagcagcuccucuucuuccgcuccacgaugccgggcugcagcggguaccccaacauggaccuggacugccugcucccccaggaguggguccagcacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacggcacggggcgccggcgcuga

SEQ ID NO: 11793 - RNA, 1617 nt, Artificial Sequence
  derived and/or modified sequence opt1 from VP1__Norovirus_and/or_Norovirus-like__EU876890
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaacuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacaccgggcagcacgaccuggugaucccgcccaacggcuacuuccgcuucgacuccugggugaaccaguucuacacgcuggcccccauggggaacggcgcgggccggcgccgcuga

SEQ ID NO: 11794 - RNA, 1617 nt, Artificial Sequence
  derived and/or modified sequence opt1 from VP1__Norovirus_and/or_Norovirus-like__AB385638
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccaacacccaggaguacaccaugaaccuggccucccagaacuggaacaacuacgacccgacggaggagauccccgcgccccugggcacccccgacuucgugggcaagauccaggggguccucacccagaccacgcggcgggacggcagcacccgcgggcacaaggccaccgugagcaccggcuccgugcacuucacgccgaagcuggggcggauccaguucagcaccgacaccuccaacgacuucgagaccggccagaacacgcgcuucacccccgucggcguggugcaggacgggagcaccacccaccagaacgagccccagcaguggguccugcccaacuacuccggcggggacggccacaacgugcaccucgccccggccguggcccccagcuuccccggggagcagcugcuguucuuccgguccacgaugcccggcugcagcggcuacccgaacaugaaccucgacugccugcugccccaggaguggguccagcacuucuaccaggaggccgcgcccgcccaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcgcccauggggaacggcacgggccggcgccgcuga

SEQ ID NO: 11795 - RNA, 1617 nt, Artificial Sequence
  derived and/or modified sequence opt1 from VP1__Norovirus_and/or_Norovirus-like__AB385635
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccgacuccugccgcgugcugacccggccgagccccgacuucgacuucaucuuccucgucccgcccaccguggagucccgcaccaagcccuucagcgugcccauccugaccgucgaggagaugaccaacucccgguuccccaucccccuggagaagcuguucacgggcccgagcuccgccuucguggugcagccccagaacgggcgcugcaccaccgacggcguccugcuggggaccacgcagcucagccccgugaacaucugcaccuuccggggcgacgucacccacaucgccggcacccagaacuacacgaugaaccuggccucccagaacuggaacaacuacgacccgaccgaggagauccccgcgccccuggggacccccgacuucgugggcaagauccagggggugcucacccagacgacccgccgggacggcagcacccgcgggcacaaggccaccgucuccacgggcagcgugcacuucaccccgaagcugggcagcgugcaguucuccaccgacaccagcaacgaccuggagacggggcagaacacccgguucacccccgucggcguggugcaggacggguccaccacgcaccagaacgagccccagcaguggguccuccccgacuacagcggccgcgacucccacaacgugcaccuggccccggccguggcccccaccuuccccggggagcagcuccucuucuuccggagcaccaugcccggcugcuccggcuacccgaacaugaaccuggacugccugcucccccaggaguggguccagcacuucuaccaggagagcgcccccgcgcaguccgacguggcccugcugcgcuucgugaaccccgacaccgggcggguccucuucgagugcaagcugcacaagagcggcuacgugaccguggcccacacggggcagcacgaccuggucaucccgcccaacggcuacuuccgcuucgacuccugggugaaccaguucuacacccucgcccccauggggaacggcgcgggccggcgccgcuga

SEQ ID NO: 11796 - RNA, 1617 nt, Artificial Sequence
  derived and/or modified sequence opt1 from VP1__Norovirus_and/or_Norovirus-like__EU366113
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguccagcacggacaccgagaacgacuucgagacccaccagaacaccaaguucacgcccgucggcgugauccaggacggguccaccacccaccgcaacgagccccagcagugggugcuccccagcuacuccggccggaacguccacaacgugcaccuggccccggccguggcgcccaccuuccccggggagcagcuccucuucuuccgcagcacgguccccggcugcuccggcuacccgaacauggaccuggacugccugcucccccaggagugggugcagcacuucuaccaggaggccgcccccgcccagagcgacguggcgcugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcuga

SEQ ID NO: 11797 - RNA, 1617 nt, Artificial Sequence
  derived and/or modified sequence opt1 from VP1__Norovirus_and/or_Norovirus-like__KX354097
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccaccaagacggacggcagcacccgcgggcacaaggccaccguguacaccggcagcgccgacuucgccccgaagcugggccgggugcaguucgagacggacaccaaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccggcgcuga

SEQ ID NO: 11798 - RNA, 1617 nt, Artificial Sequence
  derived and/or modified sequence opt1 from VP1__Norovirus_and/or_Norovirus-like__AB933727
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggaggugccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccgcaacgagccccagcaguggguccuccccagcuacuccgggcgggacgugccgaacgugcaccuggcccccgccgucgcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacguggcgcugcugcgguucgucaacccggacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcuga

SEQ ID NO: 11799 - RNA, 1617 nt, Artificial Sequence
  derived and/or modified sequence opt1 from VP1__Norovirus_and/or_Norovirus-like__AB933726
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcuga

SEQ ID NO: 11800 - RNA, 1617 nt, Artificial Sequence
  derived and/or modified sequence opt1 from VP1__Norovirus_and/or_Norovirus-like__AB933720
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagguccagggggugcugacccagaccaccaagggcgacgggagcacgcggggccacaaggccaccguguacaccggcagcgcccccuucaccccgaagcugggguccguccaguucagcacggacaccgagaacgacuucgagacccaccagaacaccaaguucacgcccgugggcgugauccaggacggguccaccacccaccgcaacgagccccagcaguggguccuccccagcuacuccggccggaacgugccgaacgugcaccuggcccccgccgucgcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacguggcgcugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcuga

SEQ ID NO: 11801 - RNA, 1617 nt, Artificial Sequence
  derived and/or modified sequence opt1 from VP1__Norovirus_and/or_Norovirus-like__AB933691
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccgggacgugccgaacguccaccuggcccccgccguggcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcuga

SEQ ID NO: 11802 - RNA, 1617 nt, Artificial Sequence
  derived and/or modified sequence opt1 from VP1__Norovirus_and/or_Norovirus-like__AB933682
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccacaacuacaccaugaaccuggccagccugaacuggaacaacuacgaccccacggaggagaucccggcgccccucgggacccccgacuucgugggcaagauccaggggguccugacccagaccacgaagggcgacggguccacccgcggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccggaacgagccccagcagugggugcuccccagcuacuccgggcgcaacguccagaacgugcaccuggccccggccguggcccccacguuccccggcgagcagcuccucuucuuccggagcaccaugcccggcugcuccggguacccgaacauggaccuggacugccugcucccccaggaguggguccagcacuucuaccaggaggcggcccccgcccagagcgacguggcccugcugcgcuucgugaaccccgacaccggccggguccucuucgagugcaagcugcacaaguccggguacgugaccguggcgcacaccggccagcacgaccuggucaucccgcccaacggguacuuccgcuucgacagcugggugaaccaguucuacacgcucgcccccaugggcaacggcaccgggcggcgccgguga

SEQ ID NO: 11803 - RNA, 1617 nt, Artificial Sequence
  derived and/or modified sequence opt1 from VP1__Norovirus_and/or_Norovirus-like__KM245069
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccuccacccaggaguacaccaugaaccuggccagccagaacuggaacaacuacgacccgacggaggagauccccgcgccccugggcacccccgacuucgugggcaagauccaggggguccucacccagaccacgcggcgggacggcagcacccgcgggcacaaggccaccguguccaccggcagcgugcacuucacgccgaagcuggggcggauccaguucuccaccgacaccagcaacgacuucgagaccggccagaacacgcgcuucacccccgucggcguggugcaggacggguccaccacccaccagaacgagccccagcaguggguccugcccaacuacagcggccgggacucccacaacgugcaccucgccccggccguggcccccagcuuccccggggagcagcugcuguucuuccgcuccacgaugcccggcugcagcggguacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacggggcgccgccgguga

SEQ ID NO: 11804 - RNA, 1617 nt, Artificial Sequence
  derived and/or modified sequence opt1 from VP1__Norovirus_and/or_Norovirus-like__LC005717
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggaucaagaacaacuucguccaggcccccgggggcgaguucaccgugagcccccgcaacgcgcccggggagauccugugguccgcgccccugggcccggaccucaaccccuaccugucccaccuggcccggauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcgccagcuggagcccgugcucaucccgcugcccgacguccggaacaacuucuaccacuacaaccagagcaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggaccaagcccuucacgguccccauccugaccguggaggagaugaccaacucccgcuuccccaucccccuggagaagcuguucaccggccccagcggggccuucgugguccagccgcagaacggccggugcacgaccgacggggugcugcugggcaccacccagcucucccccgucaacaucugcacguuccgcggcgacgugacccacaucgccgggagccggaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcgcggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccggaacgagccccagcagugggugcuccccuccuacagcgggcgcaacguccacaacgugcaccuggcccccgccguggccccgaccuuccccggcgagcagcuccucuucuuccgguccacgaugcccggcugcagcggguaccccaacauggaccuggacugccugcucccgcaggaguggguccagcacuucuaccaggaggccgcccccgcgcaguccgacguggcccugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgguga

SEQ ID NO: 11805 - RNA, 1617 nt, Artificial Sequence
  derived and/or modified sequence opt1 from VP1__Norovirus_and/or_Norovirus-like__LC005705
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccaucuacaccggguccgcccccuucaccccgaagcugggcagcgugcaguucagcacggacaccgagaacgacuucgagacccaccagaacaccaaguucacgcccgugggggucauccaggacggcuccaccacccaccgcaacgagccccagcagugggugcuccccagcuacuccgggcggaacgugcacaacguccaccuggccccggccguggcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11806 - RNA, 1617 nt, Artificial Sequence
  derived and/or modified sequence opt1 from VP1__Norovirus_and/or_Norovirus-like__KC894943
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccaacuacagcggguccgacgucccgaacgugcaccuggcccccgccguggcgcccaacuuccccggcgagcagcuccucuucuuccggagcaccaugccgggcugcuccggguaccccaacauggaccuggacugccugcucccccaggaguggguccagcacuucuaccaggaggccgcccccgcccagagcgacguggcgcugcugcgcuucgugaacccggacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgguga

SEQ ID NO: 11807 - RNA, 1617 nt, Artificial Sequence
  derived and/or modified sequence opt1 from VP1__Norovirus_and/or_Norovirus-like__KF060023
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgggacggacaccgaccacgacuucgaggccaaccagaacaccaaguucacccccgucggcgugauccaggacgggagcacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 11808 - RNA, 1617 nt, Artificial Sequence
  derived and/or modified sequence opt1 from VP1__Norovirus_and/or_Norovirus-like__KC409310
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgacccgacggaggagauccccgcgccccucggcacccccgacuucguggggaagauccagggcguccugacccagaccacgaagggggacggcuccacccggggccacaaggccaccguguacaccgggagcgccccguucacgcccaagcugggcuccgugcaguucagcaccgacaccgagaacgacuucgagacccaccagaacacgaaguucacccccgucggggugauccaggacggcgggaccacccaccgcaacgagccccagcagugggugcucccgagcuacuccggccgggacguccacaacgugcaccuggcccccgccguggcgcccacguuccccggcgagcagcuccucuucuuccgcagcaccaugccggggugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgccggcgcuga

SEQ ID NO: 11809 - RNA, 1617 nt, Artificial Sequence
  derived and/or modified sequence opt1 from VP1__Norovirus_and/or_Norovirus-like__JX989073
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccgggacaucccgaacgugcaccuggcccccgccgucgcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacguggcgcugcugcgguucgucaacccggacaccgggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgccggcgcuga

SEQ ID NO: 11810 - RNA, 1617 nt, Artificial Sequence
  derived and/or modified sequence opt1 from VP1__Norovirus_and/or_Norovirus-like__JX459902
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccagcuucccgaucgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcaacgugacgcacaucagcggcagccgcaacuacaccaugaaccuggccucccagaacuggaacagcuacgacccgaccgaggagauccccgcgccccuggggacccccgacuucgucggcaagauccagggggugcucacgcagaccaccaagaccaacggcuccacgcgggggcacaaggccaccguguacaccggcagcgccgacuucuccccgaagcugggccgcguccaguucgccaccgacacggacaacgacuucgagaccaaccagaacaccaaguucacccccgugggggugauccaggacggcagcacgacgccccggaacgagccccagcaguggguccugccguccuacagcgggcgcaacacccacaacgugcaccucgcccccgccguggcccccaccuuccccggcgagcagcugcuguucuuccgguccaccaugccggggugcagcggcuaccccaacauggaccucgacugccugcugccccaggaguggguccaguacuucuaccaggaggcggcccccgcccaguccgacguggcccuccugcgcuucgugaacccggacaccggccggguccuguucgagugcaagcuccacaagagcggguacgugaccguggcgcacaccggccagcacgaccuggucaucccgcccaacggguacuuccgcuucgacuccugggugaaccaguucuacacccuggcccccaugggcaacgggacgggccggcgccgcuga

SEQ ID NO: 11811 - RNA, 1617 nt, Artificial Sequence
  derived and/or modified sequence opt1 from VP1__Norovirus_and/or_Norovirus-like__JX459644
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaccuuccccggcgagcagcuccucuucuuccgcuccacgaugcccggcugcagcggguaccccaacaugaaccuggacugccugaucccgcaggaguggguccagcacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggcgccgggcgccggcgcuga

SEQ ID NO: 11812 - RNA, 1617 nt, Artificial Sequence
  derived and/or modified sequence opt1 from VP1__Norovirus_and/or_Norovirus-like__JX459610
augaagauggccagcaacgacgcccaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaccaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11813 - RNA, 1617 nt, Artificial Sequence
  derived and/or modified sequence opt1 from VP1__Norovirus_and/or_Norovirus-like__JX459606
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggcgcgcgccccugggcccggaccucaaccccuaccugucccaccuggcccggauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccaguccaacgacagcaccaucaagcugaucgccaugcucuacacgccccugcgcgcgaacaacgccggcgaggacguguucaccguguccugccggguccugacccgccccagcccggacuucgacuucaucuuccucgugccgcccaccguggagucccggaccaagcccuucacgguccccauccugaccguggaggagaugaccaacagccgcuuccccaucccccuggagaagcuguucaccggccccuccagcgccuucgugguccagccgcagaacgggcggugcacgaccgacggcgugcugcuggggaccacccagcucucccccgucaacaucugcacguuccgcggcgacgugacccacaucgccggcagccggaacuacaccaugaaccuggccucccugaacuggaacaacuacgaccccaccgaggaggugccggcgccccucgggacgcccgacuucgucggcaagauccagggggugcugacccagaccaccaagggcgacgggagcacgcgcggccacaaggccaccguguacaccggcuccgcccccuucaccccgaagcuggggagcguccaguucagcacggacaccgagaacgacuucgagacccaccagaacaccaaguucacgcccgugggcgugauccaggacggguccaccacccaccggaacgagccccagcaguggguccuccccagcuacuccggccgcaacgugcacaacgugcaccuggccccggccgucgcgcccaccuuccccggggagcagcuccucuucuuccggagcacgaugcccggcugcuccggcuacccgaacauggaccuggacugccugcucccccaggagugggugcagcacuucuaccaggaggccgcccccgcccagagcgacguggcgcugcugcgcuucgucaaccccgacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccggcgccgcuga

SEQ ID NO: 11814 - RNA, 1617 nt, Artificial Sequence
  derived and/or modified sequence opt1 from VP1__Norovirus_and/or_Norovirus-like__JX445159
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccgagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11815 - RNA, 1617 nt, Artificial Sequence
  derived and/or modified sequence opt1 from VP1__Norovirus_and/or_Norovirus-like__JN400606
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcggggcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11816 - RNA, 1617 nt, Artificial Sequence
  derived and/or modified sequence opt1 from VP1__Norovirus_and/or_Norovirus-like__JQ613562
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaaguccuucacgguccccauccugaccguggaggagaugaccaacagccgguuccccaucccccuggagaagcuguucaccggccccuccagcgccuucgugguccagccccagaacgggcgcugcacgaccgacggcgugcugcuggggaccacccagcucuccccggucaacaucugcacguuccggggcgacgugacccacaucgccggcagccgcaacuacaccaugaaccuggccucccugaacuggaacaacuacgaccccaccgaggagauccccgcgccgcucgggacgcccgacuucgugggcaagauccaggggguccugacccagaccaccaagggcgacgggagcacgcggggccacaaggccaccguguacaccggcagcgccgacuucacccccaagcugggguccgugcaguucggcacggacaccgacaacgacuucgagacccaccagaacaccaaguucacgcccgucggggugauccaggacggcagcaccacccaccgcaacgagccgcagcagugggugcuccccuccuacagcgggcggaacguccacaacgugcaccuggcccccgccguggcgcccaacuucccgggcgagcagcuccucuucuuccgcuccaccaugcccggcugcagcggguaccccaacauggaccuggacugccugcucccccaggaguggguccagcacuucuaccaggaggccgccccggcccaguccgacguggcgcugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcgccgggcgcaagcgguga

SEQ ID NO: 11817 - RNA, 1617 nt, Artificial Sequence
  derived and/or modified sequence opt1 from VP1__Norovirus_and/or_Norovirus-like__HQ456343
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugccgcccagcuacuccggccggaacguccacaacgugcaccucgcccccgcgguggcccccaacuuccccggggagcagcugcuguucuuccgcagcaccaugcccggcugcuccggcuacccgaacauggaccucgacugccugcugccccaggaguggguccagcacuucuaccaggaggccgcccccgcgcagagcgacguggcccuccugcgguucgugaaccccgacacggggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcaccggccgccggcgcuga

SEQ ID NO: 11818 - RNA, 1617 nt, Artificial Sequence
  derived and/or modified sequence opt1 from VP1__Norovirus_and/or_Norovirus-like__HQ456342
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgggaccgcgcaccgcaacgagccccagcagugggugcugcccuccuacagcggccggaacucccacaacguccaccucgccccggccguggcccccaccuuccccggggagcagcugcuguucuuccgcagcaccaugcccggcugcuccggcuacccgaacauggaccucgacugccugcugccccaggagugggugcaguacuucuaccaggaggcggcccccgcccagagcgacgucgcccuccugcgguucgugaaccccgacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcgcccauggggaacggcaccggccgccgccgguga

SEQ ID NO: 11819 - RNA, 1617 nt, Artificial Sequence
  derived and/or modified sequence opt1 from VP1__Norovirus_and/or_Norovirus-like__HQ456340
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcuguccagcucccaggugaccauguucccccacaucaucgucgacgugcggcagcuggagcccgugcucaucccccugccggacguccgcaacaacuucuaccacuacaaccagagcuccgacagcaccaucaagcugaucgccaugcucuacacgccccugcgggcgaacaacgccggcgaggacguguucaccguguccugccgcguccugacccggcccagccccgacuucgacuucaucuuccucgugccgcccaccguggagucccgcaccaagcccuucacgguccccauccugaccguggaggagaugaccaacagccgguucccgaucccccuggagaagcuguucaccggccccuccggggccuucgugguccagccccagaacggccgcugcacgaccgacggggugcugcugggcaccacccagcucagcccggucaacaucugcacguuccggggcgacgugacccacaucgccgggucccgcaacuacaccaugaaccuggccgcgcugaacuggaacaacuacgaccccaccgaggagauccccgccccgcucggcacgcccgacuucguggggaagauccagggcguccugacccagaccaccaaggccgacgggagcacgcggggccacaaggccaccguguacaccggcagcgccgacuucacccccaagcugggguccgugcaguucagcacggacaccgagaacgacuucgagacccaccagaacaccaaguucacgcccgucggcgugauccaggacggguccaccacccaccgcaacgagccgcagcagugggugcuccccagcuacuccggccggaacguccacaacgugcaccuggcgcccgccguggcccccaccuucccgggggagcagcuccucuucuuccgcagcacgaugcccggcugcuccggcuaccccaacauggaccuggacugccugcucccccaggaguggguccagcacuucuaccaggaggccgcgccggcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11820 - RNA, 1617 nt, Artificial Sequence
  derived and/or modified sequence opt1 from VP1__Norovirus_and/or_Norovirus-like__HQ456326
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucgucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcggggccuucgucgugcagccgcagaacggccgcugcacgaccgacgggguccugcugggcaccacccagcucucccccgugaacaucugcacguuccggggcgacgugacccacaucgccgggagccgcaacuacaccaugaaccuggccucccugaacuggaacaacuacgaccccaccgaggagaucccggcgccccucggcacgcccgacuucgucgggaagauccagggcgugcugacccagaccaccaagggggacggcagcacgcggggccacaaggccaccguguacaccggguccgcccccuucaccccgaagcugggcagcguccaguucagcacggacaccgagaacgacuucgagacccaccagaacaccaaguucacgcccgugggggugauccaggacggcuccaccacccaccgcaacgagccccagcaguggguccuccccagcuacuccgggcggaacgugcacaacgugcaccuggccccggccgucgcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcuga

SEQ ID NO: 11821 - RNA, 1617 nt, Artificial Sequence
  derived and/or modified sequence opt1 from VP1__Norovirus_and/or_Norovirus-like__HM802527
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucagcgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugacccaggacggcagcaccacccaccgcaacgagccccagcagugggugcuccccuccuacagcgggcggaacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcuga

SEQ ID NO: 11822 - RNA, 1617 nt, Artificial Sequence
  derived and/or modified sequence opt1 from VP1__Norovirus_and/or_Norovirus-like__GQ856448
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcgggacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11823 - RNA, 1617 nt, Artificial Sequence
  derived and/or modified sequence opt1 from VP1__Norovirus_and/or_Norovirus-like__AB541347
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgugcccuucaccccgaagcugggcagcguccaguucagcacggacaccgagaacgacuucgagacccaccagaacaccaaguucacgcccgugggggugauccaggacggcuccaccacccaccgcaacgagccccagcaguggguccuccccagcuacuccgggcggaacgugcacaacgugcaccuggccccggccgucgcccccaccuuccccggcgagcagcuccucuucuuccgcagcacgaugcccggcugcuccggguacccgaacauggaccuggacugccugcucccccaggagugggugcagcacuucuaccaggaggcggcccccgcccagagcgacguggcccugcugcgguucgucaaccccgacaccggccgcguccucuucgagugcaagcugcacaaguccggguacgugaccguggcgcacaccggccagcacgaccuggugaucccgcccaacggguacuuccgguucgacagcugggugaaccaguucuacacccucgcccccaugggcaacggcacggggcgccggcgcuga

SEQ ID NO: 11824 - RNA, 1617 nt, Artificial Sequence
  derived and/or modified sequence opt1 from VP1__Norovirus_and/or_Norovirus-like__AB541298
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucaccccgcccacgguggagagccgcaccaagcccuucaccgugcccauccugaccgucgaggagaugacgaacucccgguuccccaucccccuggagaagcuguucaccggccccagcggggccuucguggugcagccgcagaacggccgcugcaccaccgacgggguccugcugggcacgacccagcucucccccgugaacaucugcaccuuccggggcgacgucacccacaucgccgggagccgcaacuacacgaugaaccuggccucccugaacuggaacaacuacgaccccaccgaggagaucccggcgccccucggcacccccgacuucguggggaagauccagggcgugcugacccagacgaccaagggggacggcagcacccggggccacaaggccaccgucuacacgggguccgcccccuucaccccgaagcugggcagcgugcaguucagcaccgacaccgagaacgacuucgaggcccaccagaacacgaaguucacccccgugggggucauccaggacggcuccaccacccaccgcaacgagccccagcagugggugcuccccagcuacuccgggcggaacgugcagaacguccaccuggccccggcgguggcccccacguuccccggcgagcagcuccucuucuuccgcagcaccaugcccggcugcuccggguacccgaacauggaccuggacugccugcucccccaggagugggugcagcacuucuaccaggaggccgcccccgcgcagagcgaccuggcccugcuccgguucgucaaccccgacaccggccgcgugcuguucgagugcaagcugcacaaguccggguacgugaccgucgcccacaccggccagcacgaccucgugaucccgcccaacggguacuuccgguucgacagcugggugaaccaguucuacacgcuggcccccaugggcaacggcaccgggcgccggcgcuga

SEQ ID NO: 11825 - RNA, 1617 nt, Artificial Sequence
  derived and/or modified sequence opt1 from VP1__Norovirus_and/or_Norovirus-like__AB541270
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccaguacgaccuggucaucccgcccaacggguacuuccgguucgacagcugggugaaccaguucuacacccucgcccccaugggcaacggcacggggcgccggcgcuga

SEQ ID NO: 11826 - RNA, 1617 nt, Artificial Sequence
  derived and/or modified sequence opt1 from VP1__Norovirus_and/or_Norovirus-like__AB541263
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacgugugcacguuccggggcgacgugacccacaucgccggcucccgcaacuacaccaugaaccuggccagccugaacuggaacaacuacgaccccaccgaggagaucccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccgcaacgagccccagcaguggguccuccccagcuacuccgggcgggacgugccgaacgugcaccuggcccccgccgucgcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacguggcgcugcugcgguucgucaacccggacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcuga

SEQ ID NO: 11827 - RNA, 1617 nt, Artificial Sequence
  derived and/or modified sequence opt1 from VP1__Norovirus_and/or_Norovirus-like__AB541256
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaccuuccccggcgagcagcuccucuucuuccgcuccacgaugcccggcugcagcggguaccccaacauggaccuggacugccugaucccgcaggaguggguccagcacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggcgccgggcgccggcgcuga

SEQ ID NO: 11828 - RNA, 1617 nt, Artificial Sequence
  derived and/or modified sequence opt1 from VP1__Norovirus_and/or_Norovirus-like__AB541240
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccuccgagauccugugguccgcgccccuggggccggaccucaaccccuaccugagccaccuggcccgcauguacaacggcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggggaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacggccgcugcacgaccgacggggugcuccugggcaccacccagcucucccccgucaacaucugcacguuccgcggggacgugacccacaucgccggcagccggaacuacaccaugaaccuggccuccaucaacuggaacaacuacgaccccaccgaggagaucccggcgccccugggcacgcccgacuucguggggaagauccagggcguccucacccagaccaccaagggggacggcagcacgcgggggcacaaggccaccguguacaccggcagcgcccccuucaccccgaagcugggcuccgugcaguucagcacggacaccgagaacgacuucgagacccaccagaacaccaaguucacgcccgucggggugauccaggacggcgggaccacccaccagaacgagccccagcagugggugcugcccggcuacuccgggcgcaacgucccgaacgugcaccucgcccccgccguggcgcccaccuuccccggcgagcagcugcuguucuuccggagcacgaugccgggcugcuccggguaccccaacauggaccucgacugccugcugccccaggaguggguccagcacuucuaccaggaggccgcccccgcccagagcgacguggcgcuccugcgcuucgugaacccggacaccggccggguccuguucgagugcaagcuccacaaguccggguacgugaccguggcccacaccggccagcacgaccuggucaucccgcccaacggguacuuccgcuucgacagcugggugaaccaguucuacacccuggcccccaugggcaacggcacggggcggcgccgguga

SEQ ID NO: 11829 - RNA, 1617 nt, Artificial Sequence
  derived and/or modified sequence opt1 from VP1__Norovirus_and/or_Norovirus-like__AB541233
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaaggccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11830 - RNA, 1617 nt, Artificial Sequence
  derived and/or modified sequence opt1 from VP1__Norovirus_and/or_Norovirus-like__AB541215
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccccugguccgagccgcugggccccgaccugaaccccuaccucucccaccuggcccgcauguacaacggcuacgccgggggcuucgaggugcaggucauccuggccgggaacgccuucaccgcgggcaagaucaucuucgccgccgugcccccgaacuuccccacggaggggcucagccccucccaggugaccauguucccccacaucaucgucgacgugcggcagcuggagccggugcugaucccccuccccgacguccgcaacaacuucuaccacuacaaccagagcaacgacuccaccaucaagcugaucgccaugcuguacacgccccuccgggccaacaacgcgggcgaggacguguucaccgugagcugccgcguccugacccggccgucccccgacuucgacuucaucuuccuggugccgcccaccguggagagccgcaccaagccguucacgguccccauccucaccguggaggagaugaccaacucccgguuccccaucccccuggagaagcuguucaccggcccgagcuccgccuucgugguccagccccagaacgggcgcugcacgaccgacggcgugcuccuggggaccacccagcugagccccgucaacaucugcacguuccggggcgacgugacccacaucgccggcucccgcaacuacaccaugaaccucgccagccugaacuggaacaacuacgacccgaccgaggagauccccgcgccccuggggacgcccgacuucgugggcaagauccaggggguccucacccagaccaccaagggcgacggguccacgcggggccacaaggccaccguguacaccggcagcgccgacuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcugcccagcuacuccgggcggaacguccacaacgugcaccucgccccggccguggcccccaccuuccccggcgagcagcugcuguucuuccgcagcacgaugcccggcugcuccggguacccgaacauggaccucgacugccugcugccccaggaguggguccagcacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacggcacggggcgccggcgcuga

SEQ ID NO: 11831 - RNA, 1617 nt, Artificial Sequence
  derived and/or modified sequence opt1 from VP1__Norovirus_and/or_Norovirus-like__AB541201
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcuccgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11832 - RNA, 1617 nt, Artificial Sequence
  derived and/or modified sequence opt1 from VP1__Norovirus_and/or_Norovirus-like__FJ411172
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggagcaacuacgaccccacggaggagaucccggcgccccuggggacccccgacuucgugggcaagauccaggggaugcucacccagaccacgcgccgggacggcuccacccgcgggcacaaggccaccguccugaccggcagcgccgacuucgcccccaagcugggccgggugcaguucgccacggacaccgacaacgacuucgagagcggggagaacaccaaguucaccccggugggcgucauccaggacggguccacgacccaccgcaacgagccccagcagugggugcuccccaacuacagcggccggaccgggcacaacgugcaccuggcgcccgccgucgccccgaccuaccccggcgagcagcuccucuucuuccgcuccacgaugcccggcugcagcggguaccccaacauggaccuggacugccugcucccgcaggagugggugcggcacuucuaccaggaggccgcgcccgcccaguccgacguggcccugcugcgcuucgucaaccccgacaccggccgcgugcuguucgagugcaagcugcacaagagcggguacgugaccgucgcccacaccggccagcacgaccuggugaucccgcccaacggguacuuccgguucgacuccugggugaaccaguucuacacccucgcccccaugggcaacggcgcggggcgccggcgcuga

SEQ ID NO: 11833 - RNA, 1617 nt, Artificial Sequence
  derived and/or modified sequence opt1 from VP1__Norovirus_and/or_Norovirus-like__AB447449
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccacuucuacacccucgcccccaugggcaacggcacggggcgccggcgcuga

SEQ ID NO: 11834 - RNA, 1617 nt, Artificial Sequence
  derived and/or modified sequence opt1 from VP1__Norovirus_and/or_Norovirus-like__AB447431
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccgcaacgagccccagcagugggugcuccccagcuacuccgggcggaacguccacaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcguacaccggccagcacgaccuggucaucccgcccaacggguacuuccgguucgacagcugggugaaccaguucuacacgcucgcccccaugggcaacggcaccgggcgccggcgcuga

SEQ ID NO: 11835 - RNA, 1617 nt, Artificial Sequence
  derived and/or modified sequence opt1 from VP1__Norovirus_and/or_Norovirus-like__EU078415
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccagcuucgugguccagccccagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggcaagauccaggggguccucacccagacgacccgcggcgacggguccacccggggccacaaggccaccgugagcacgggcagcgugcacuucaccccgaagcugggguccguccaguucagcaccgacaccuccaacgacuucgagacgggccagaacacccgcuucacccccgugggggugguccaggacggcagcaccacgcaccagaacgagccccagcagugggugcugcccgacuacuccgggcggaacagccacaacgugcaccucgccccggccgucgcccccaccuuccccggcgagcagcugcuguucuuccgcuccaccaugcccggcugcagcggguacccgaacaugaaccucgacugccugcugccccaggagugggugcagcacuucuaccaggaguccgcccccgcccagagcgacguggcgcuccugcgguucgucaaccccgacaccggccgcgugcuguucgagugcaagcuccacaaguccggguacgugaccgucgcccacacgggccagcacgaccuggugaucccgcccaacggguacuuccgguucgacagcugggugaaccaguucuacacccuggcccccaugggcaacggcgccgggcgccggcgcuga

SEQ ID NO: 11836 - RNA, 1617 nt, Artificial Sequence
  derived and/or modified sequence opt1 from VP1__Norovirus_and/or_Norovirus-like__AB385643
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaugaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcgcggcgacggguccacccggggccacaaggccaccgugagcaccggcagcgugcacuucacgccgaagcuggggcgcauccaguucuccaccgacaccagcaacgacuucgagaccggccagaacacgcgguucacccccgucgggguggugcaggacggcuccaccacccaccagaacgagccccagcaguggguccugcccaacuacagcgggcgcgacucccacaacgugcaccucgccccggccguggcccccagcuuccccggcgagcagcugcuguucuuccgguccacgaugcccggcugcagcggguacccgaacaugaaccucgacugccugcugccccaggaguggguccagcacuucuaccaggaggccgcgcccgcccaguccgacguggcccuccugcgcuucgugaaccccgacaccggccggguccuguucgagugcaagcuccacaagagcggguacgugaccguggcccacaccggccagcacgaccuggucaucccgcccaacggguacuuccgcuucgacuccugggugaaccaguucuacacccuggcgcccaugggcaacggcacggggcggcgccgcuga

SEQ ID NO: 11837 - RNA, 1617 nt, Artificial Sequence
  derived and/or modified sequence opt1 from VP1__Norovirus_and/or_Norovirus-like__AB385636
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccgacuccugccgcgugcugacccggccgagccccgacuucgacuucaucuuccucgucccgcccaccguggagucccgcaccaagcccuucagcgugcccauccugaccgucgaggagaugaccaacucccgguuccccaucccccuggagaagcuguucacgggcccgagcuccgccuucguggugcagccccagaacgggcgcugcaccaccgacggcguccugcuggggaccacgcagcucagccccgugaacaucugcaccuuccggggcgacgucacccacaucgccggcacccagaacuacacgaugaaccuggccucccagaacuggaacaacuacgacccgaccgaggagauccccgcgccccuggggacccccgacuucgugggcaagauccagggggugcucacccagacgacccgcggcgacgggagcacccggggccacaaggccaccgucuccacgggcagcgugcacuucaccccgaagcuggggagcgugcaguucuccaccgacaccagcaacgaccuggagacgggccagaacacccgcuucacccccgucgggguggugcaggacggcuccaccacgcaccagaacgagccccagcaguggguccuccccaacuacagcgggcgggacucccacaacgugcaccuggccccggccguggcccccaccuuccccggcgagcagcuccucuucuuccgcagcaccaugcccggcugcuccggguacccgaacaugaaccuggacugccugcucccccaggaguggguccagcacuucuaccaggagagcgcccccgcgcaguccgacguggcccugcugcgguucgugaaccccgacaccggccgcguccucuucgagugcaagcugcacaagagcggguacgugaccguggcccacacgggccagcacgaccuggucaucccgcccaacggguacuuccgguucgacuccugggugaaccaguucuacacccucgcccccaugggcaacggcgcggggcgccggcgcuga

SEQ ID NO: 11838 - RNA, 1617 nt, Artificial Sequence
  derived and/or modified sequence opt1 from VP1__Norovirus_and/or_Norovirus-like__AB385629
augaagauggccagcaacgacgccacccccuccgacggcagcaccgcgaaccuggugccggaggucaacaacgaggugauggcccucgagcccguggccggggccgccaucgcggcccccgucgccggccagcagaacgugaucgaccccuggauccgcaacaacuucgugcaggcccccgggggcgaguucacggucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgaccccacgaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccauccugaccgucgaggagaugaccaacucccgguuccccaucccccuggagaagcuguucacgggcccgagcuccgccuucguggugcagccccagaacgggcgcugcaccaccgacggcguccugcuggggaccacgcagcucagccccgugaacaucugcaccuuccggggcgacgucacccacaucgccaacacccagaacuacacgaugaaccuggccucccagaacuggaacaacuacgacccgaccgaggagauccccgcgccccugggcacccccgacuucguggggcgcauccagggcgugcucacccagacgacccgcggggacggcagcacccgggggcacaaggccaccgucuccacgggcagcgugcacuucaccccgaagcugggcagcgugcaguucuccaccgacaccagcaacgaccuggagacggggcagaacacccgguucacccccgucggcguggugcaggacgggggcaccacgcaccgcaacgagccccagcaguggguccuccccgacuacuccgggcgggacagccacaacgugcaccuggccccggccguggcccccaccuuccccggcgagcagcuccucuucuuccgcuccaccaugcccggcugcagcggguacccgaacaugaaccuggacugccugcucccccaggaguggguccagcacuucuaccaggaguccgcgcccgcccagagcgacguggcccugcugcgguucgugaaccccgacaccggccgcguccucuucgagugcaagcugcacaaguccggguacgugaccguggcccacacgggccagcacgaccuggucaucccgcccaacggguacuuccgguucgacagcugggugaaccaguucuacacccucgcgcccaugggcaacggcgccgggcgccgccgguga

SEQ ID NO: 11839 - RNA, 1617 nt, Artificial Sequence
  derived and/or modified sequence opt1 from VP1__Norovirus_and/or_Norovirus-like__EU839586
augaagauggccagcaacgacgccucccccagcgacggcuccaccgcgaaccuggugccggaggucaacaacgaggugauggcccucgagcccguggucggggccgccaucgccgcgcccgugaccggccagcagaacgugaucgaccccuggauccgcaacaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgccggcgacgacguguucaccguguccugccgcguccugacccggcccagcccggacuucgacuucaucuuccucgugccgcccaccguggagucccgcaccaagcccuucaccguccccauccugaccguggaggagaugacgaacagccgguuccccaucccccuggagaagcuguucaccggccccuccagcgcguucgugguccagccgcagaacgggcgcugcaccaccgacggcgugcuccuggggacgacccagcucucccccgucaacaucugcaccuuccggggcgacgugacccacauccccggcacgcgcaccuaccggaugaaccuggccagccagaacuggaacaacuacgacccgaccgaggagauccccgcgccccuggggacccccgacuucgugggcaagauccaggggaugcucacgcagaccaccaagggcgacggguccacccgcggccacaaggccacggucagcaccggcagcguggacuucaccccgaagcugggguccgugcaguucgccaccgacacggacaacgacuucgagaccggccagaacacccgguucacccccgucggggugauccaggacggcagcuccacgcaccgcaacgagccccagcagugggugcugcccgacuacagcgggcggaccgcccacaacguccaccucgccccggccguggcccccaccuuccccggcgagcagcugcuguucuuccgcuccaccaugcccggcugcagcggguacccgaacauggaccucgacugccugcugccccaggagugggugcagcacuucuaccaggaggccgcgcccucccagagcgacgucgcccuccugcgguucgugaaccccgacaccggccgcgugcuguucgagugcaagcuccacaaggccggguacgucacgguggcccacaccggccagcacgaccuggugaucccgcccaacggguacuuccgguucgacuccugggucaaccaguucuacacccuggcgcccaugggcaacggcgccgggcgccgccgguga

SEQ ID NO: 11840 - RNA, 1617 nt, Artificial Sequence
  derived and/or modified sequence opt1 from VP1__Norovirus_and/or_Norovirus-like__EU310927
augaagauggccagcuccgacgccagccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggacccacgacuacacgaugaaccuggccucccagaacuggaacaacuacgacccgaccgaggagauccccgcgccccugggcacccccgacuucguggggaagauccagggcguccucacccagacgacccgcggggacggcagcacccggggccacaaggccaccguguccacggggagcgugcacuucaccccgaagcugggcagcguccaguucaccaccgacacgaacaacgaccuggagaccgggcagaacaccaaguucacccccgugggcgugguccaggacgggaacuccgcccaccagaacgagccccagcagugggugcuccccaacuacagcggccgcacgggccacaacgugcaccuggccccggccgucgcccccaccuuccccggggagcagcuccucuucuuccgguccaccaugcccggcugcagcggguacccgaacaugaaccuggacugccugcucccccaggagugggugcugcacuucuaccaggaggcggcccccgcccaguccgacguggcccugcuccgcuucgucaaccccgacaccggccgggugcuguucgagugcaagcugcacaagagcggguacgugaccgucgcgcacacgggcccgcacgaccucgugaucccgcccaacggcuacuuccgcuucgacuccugggugaaccaguucuacacccuggcccccauggggaacggcgccgggcggcgccgguga

SEQ ID NO: 11841 - RNA, 1617 nt, Artificial Sequence
  derived and/or modified sequence opt1 from VP1__Norovirus_and/or_Norovirus-like__AB294787
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcuccuggggaccacccagcucucccccgucaacaucugcacguuccggggcgacgugacccacaucagcggcacccgcaccuaccggaugaaccuggccucccagaacuggaacaacuacgaccccacggaggagaucccggcgccccuggggacccccgacuucgugggcaagauccaggggaugcucacccagaccacgaagggcgacgggagcacccgcggccacaaggccaccgucagcaccggcuccguggacuucacgcccaagcuggggagcgugcaguucgccaccgacaccgacaacgacuucgagaccggccagaacacgcgguucaccccggucggggugauccaggacggcuccagcgcccaccgcaacgagccccagcagugggugcugcccgacuacuccgggcggaccguccacaacgugcaccucgcccccgccguggcgccgaccuuccccggcgagcagcugcuguucuuccgcagcacgaugcccggcugcuccggguaccccaacauggaccucgacugccugcugccgcaggaguggguccagcacuucuaccaggaggccgcccccagccaguccgacguggcccuccugcgguucgugaaccccgacaccggccgcguccuguucgagugcaagcuccacaaggcgggguacgugaccguggcccacaccggccagcacgaccuggucaucccgcccaacggguacuuccgguucgacagcugggugaaccaguucuacacccuggcccccaugggcaacggcgccgggcgccgccgguga

SEQ ID NO: 11842 - RNA, 1617 nt, Artificial Sequence
  derived and/or modified sequence opt1 from VP1__Norovirus_and/or_Norovirus-like__AY587987
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcgccuuccggggcgacgugacccacaucgccgggacccacaacuacaccaugaaccuggccucccagaacuggaacaacuacgacccgacggaggagauccccgcgccccugggcacccccgacuucguggggcgcauccagggcaugcucacccagaccacgcgcggggacggcagcacccggggccacaaggccaccgucuccaccggggacgugcacuucacgccgaagcugggcagcauccaguucaacaccgacaccaacaacgacuucgagaccgggcagaacacgaaguucacccccgugggcgucgugcaggacgggaacggcacccaccagaacgagccccagcagugggugcugcccuccuacagcggccggaccgggcacaacguccaccucgccccggccguggcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaaguccggcuacgucaccguggcgcacaccggccagcacgaccuggugaucccgcccaacggguacuuccgguucgacagcugggucaaccaguucuacacgcuggcccccaugggcaacgggaccggccgccggcgcuga

SEQ ID NO: 11843 - RNA, 1617 nt, Artificial Sequence
  derived and/or modified sequence opt1 from VP1__Norovirus_and/or_Norovirus-like__AY502019
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucguguucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgaggacguguucaccgucuccugccgcgugcugacccggccgagccccgacuucgacuucaucuuccucgugccgcccaccgucgagucccgcacgaagcccuucaccgugcccauccugaccguggaggagaugaccaacagccgguuccccaucccccuggagaagcuguucacgggcccguccagcgccuucgucgugcagccccagaacgggcgcugcaccaccgacggcguccuccuggggaccacgcagcucucccccgugaacaucugcaccuuccggggcgacgugacccacaucgccggcacccacaacuacacgaugaaccuggccagccagaacuggaacaacuacgacccgaccgaggagauccccgcgccccuggggacccccgacuucgucggccgcauccaggggaugcucacccagacgacccggggcgacggguccacccgcggccacaaggccaccgugagcacgggcgacgugcacuucaccccgaagcugggguccauccaguucaacaccgacaccaacaacgacuucgagacgggccagaacaccaaguucacccccgucgggguggugcaggacggcaacgggacccaccagaacgagccccagcaguggguccugcccagcuacagcggccggacgggccacaacgugcaccucgccccggccguggcccccaccuuccccggggagcagcugcuguucuuccgcuccaccaugcccggcugcagcggguacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggguacgugaccguggcccacacgggccagcacgaccuggucaucccgcccaacggcuacuuccgguucgacuccugggugaaccaguucuacacccuggcgcccauggggaacggcaccgggcgccggcgcuga

SEQ ID NO: 11844 - RNA, 1617 nt, Artificial Sequence
  derived and/or modified sequence opt1 from VP1__Norovirus_and/or_Norovirus-like__LC177653
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucguguucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcggggccuucaucguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgaggcccaccagaacaccaaguucacccccgucggggugauccaggacggcgggacgacccaccgcaacgagccccagcagugggugcuccccuccuacagcggccgggacguccacaacgugcaccuggccccggcgguggcccccaccuuccccggcgagcagcuccucuucuuccgcuccaccaugcccgggugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggaccggccgccggcgcuga

SEQ ID NO: 11845 - RNA, 1617 nt, Artificial Sequence
  derived and/or modified sequence opt1 from VP1__Norovirus_and/or_Norovirus-like__AB972486
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgccacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgcgguggcccccaccuuccccggcgagcagcuccucuucuuccgcuccacgaugccgggcugcagcggguaccccaacauggaccuggacugccugcucccccaggagugggugcagcacuucuaccaggaggccgcccccgcgcaguccgacgucgcccugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 11846 - RNA, 1617 nt, Artificial Sequence
  derived and/or modified sequence opt1 from VP1__Norovirus_and/or_Norovirus-like__KR904235
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccacgccccugggcccggaccucaaccccuaccugagccaccuggcgcgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccgugcugaccguggaggagaugaccaacagccgguuccccaucccccuggagaagcuguucacgggcccguccagcgcguucgucgugcagccccagaacgggcgcugcaccaccgacggcguccuccuggggaccacgcagcucucccccgugaacaucugcaccuuccggggcgacgugacccacaucagcggcucccgcaacuacaccaugaaccuggccagccagaacuggaacagcuacgacccgacggaggagauccccgcgccccuggggacccccgacuucgucggcaagauccagggggugcucacccagaccacgcggaccgacggcuccacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcagcaccacccaccgcaacgagccccagcaguggguccugcccuccuacagcgggcggaacacgcacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggccgcgcccgcccaguccgacguggcccuccugcgguucgugaaccccgacaccggccgcguccuguucgagugcaagcuccacaagagcggguacgugaccguggcccacacgggccagcacgaccuggucaucccgcccaacggguacuuccgguucgacuccugggugaaccaguucuacacccuggcgcccaugggcaacgggaccggccgccgccgguga

SEQ ID NO: 11847 - RNA, 1617 nt, Artificial Sequence
  derived and/or modified sequence opt1 from VP1__Norovirus_and/or_Norovirus-like__AB933753
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccgcaacuacaccaugaaccuggccucccagaacuggaacagcuacgacccgacggaggagauccccgcgccccuggggacccccgacuucgugggcaagauccaggggguccucacccagaccacgcggaccgacggcagcacccgcgggcacaaggccaccguguacacgggcuccgccgacuucagcccgaagcugggccgggugcaguucgccaccgacaccgacaacgacuucgacgccaaccagaacaccaaguucacgcccgucggggugauccaggacggcgggaccgcccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 11848 - RNA, 1617 nt, Artificial Sequence
  derived and/or modified sequence opt1 from VP1__Norovirus_and/or_Norovirus-like__AB933721
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccggcucccgcaacuacaccaugaaccuggccagccugaacuggaacaacuacgaccccaccgaggagaucccggcgccccucgggacgcccgacuucgucggcaagauccaggggaugcugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgucccgaacgugcaccuggcccccgccguggcgcccaccuuccccggggagcagcuccucuucuuccgcuccacgaugccgggcugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11849 - RNA, 1617 nt, Artificial Sequence
  derived and/or modified sequence opt1 from VP1__Norovirus_and/or_Norovirus-like__AB933706
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggccuccugcucgggaccacccagcugagccccgugaacaucugcacguuccggggcgacgucacccacaucgccggcucccgcaacuacaccaugaaccuggccagccucaacuggaacaacuacgaccccaccgaggagaucccggcgccccuggggacgcccgacuucgugggcaagauccaggggaugcugacccagaccaccaagggcgacggguccacgcggggccacaaggccaccguguacaccggcagcgcccccuucaccccgaagcucgggagcguccaguucuccacggacaccgagaacgacuucgagacccaccagaacaccaaguucacgcccgugggcgugauccaggacgggagcaccacccaccgcaacgagccccagcaguggguccugcccuccuacagcggccggaacgugccgaacgugcaccuggcccccgccgucgcgcccaccuuccccggggagcagcuccuguucuuccgcuccacgaugccgggcugcagcggcuaccccaacauggaccuggacugccuccugccccaggagugggugcagcacuucuaccaggaggccgcccccgcccaguccgacguggcgcugcuccgguucgucaacccggacaccgggcgcgugcuguucgagugcaagcugcacaagagcggcuacgugaccgucgcccacaccgggcagcacgaccucgugaucccgcccaacggcuacuuccgguucgacuccugggugaaccaguucuacacccuggcccccauggggaacggcacgggccgccggcgcuga

SEQ ID NO: 11850 - RNA, 1617 nt, Artificial Sequence
  derived and/or modified sequence opt1 from VP1__Norovirus_and/or_Norovirus-like__AB933669
augaagauggccagcaacgacgccaccgcguccgacggcagcgccgccaaccuggugcccgaggucaacaacgaggugauggcccucgagccgguggucggggccgcgaucgccgcccccguggccggccagcagaacgugaucgaccccuggauccgcaacaacuucguccaggcgcccgggggcgaguucaccguguccccgcggaacgcccccggggagauccuguggagcgcgccccugggccccgaccucaacccguaccugucccaccuggcccgcauguacaacggcuacgccgggggcuucgaggugcaggucauccucgccgggaacgccuucacggccggcaagaucaucuucgccgccgugccgcccaacuuccccaucgaggggcugagccccucccaggugaccauguucccccacaucaucgucgacgugcggcagcuggagcccgugcucaucccccugccggacguccgcaacaacuucuaccacuacaaccagagcaacgacuccaccaucaagcugaucgcgaugcucuacacgccccugcgggccaacaacgccggcgaggacguguucaccgugagcugccgcguccugacccggcccucccccgacuucgacuucaucuuccucgugccgcccaccguggagagccgcaccaagcccuucacgguccccauccugaccguggaggagaugaccaacucccgguucccgaucccccuggagaagcuguucaccggccccagcuccgccuucgugguccagccccagaacgggcgcugcacgaccgacggcgugcugcuggggaccacccagcucagcccggucaacaucugcacguuccggggcgacgugacccacaucgccggcucccgcaacuacaccaugaaccuggcgagccugaacuggaacaacuacgaccccaccgaggagauccccgccccgcucgggacgcccgacuucgugggcaagauccaggggguccugacccagaccaccaagggcgacggguccacgcggggccacaaggccaccguguacaccggcagcgcccccuucacccccaagcuggggagcgugcaguucuccacggacaccgagaacgacuucgagacccaccagaacaccaaguucacgccggucggcgugauccaggacgggggcaccacccaccgcaacgagccccagcagugggugcuccccagcuacuccgggcggaacguccccaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11851 - RNA, 1617 nt, Artificial Sequence
  derived and/or modified sequence opt1 from VP1__Norovirus_and/or_Norovirus-like__EU921350
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcacccaggaguacaccaugaaccuggccagccagaacuggaacaacuacgacccgacggaggagauccccgcgccccuggggacccccgacuucgugggcaagauccaggggguccucacccagaccacgcgccgggacggcuccacccgcgggcacaaggccaccgugagcaccggcagcgugcacuucacgccgaagcugggccggauccaguucuccaccgacaccagcaacgacuucgagaccgggcagaacacgcgcuucacccccgucggcguggugcaggacggguccaccacccaccagaacgagccccagcagugggcccugcccgacuacagcggccgggacucccacaacguccaccucgccccggccguggcccccagcuuccccggggagcagcugcuguucuuccgcuccacgaugcccggcugcagcggcuacccgaacaugaaccucgacugccugcugccccaggagugggugcagcacuucuaccaggaggcggcccccgcccaguccgacgucgcccuccugcgguucgugaaccccgacaccgggcgcgugcuguucgagugcaagcuccacaagagcggcuacgucaccguggcgcacaccgggcagcacgaccuggugaucccgcccaacggcuacuuccgguucgacuccugggucaaccaguucuacacccuggcccccauggggaacggcacgggccgccgccgguga

SEQ ID NO: 11852 - RNA, 1617 nt, Artificial Sequence
  derived and/or modified sequence opt1 from VP1__Norovirus_and/or_Norovirus-like__LC005712
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccaucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcgggacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11853 - RNA, 1617 nt, Artificial Sequence
  derived and/or modified sequence opt1 from VP1__Norovirus_and/or_Norovirus-like__LC018707
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccaacuucuccccgaagcugggccgggugcaguucgagacggacaccgaccacgacuucgaggucaaccagaacaccaaguucacccccgugggggugauccaggacggcagcacgacccaccgcaacgagccccagcaguggguccugcccuccuacagcgggcggaacaccccgaacgugcaccucgcccccgccguggcccccaccuuccccggcgagcagcugcuguucuuccgcuccacgaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 11854 - RNA, 1617 nt, Artificial Sequence
  derived and/or modified sequence opt1 from VP1__Norovirus_and/or_Norovirus-like__KM982955
augaagauggccagcuccgacgccacccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucacggccggcaaggugaucuucgccgccgugccgcccaacuucccgaccgaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcacgaagcccuucuccgugcccguccugaccguggaggagaugaccaacagccgguuccccaucccccuggagaagcuguucaccggcccguccagcgccuucgucgugcagccccagaacgggcgcugcacgaccgacggcgugcuccuggggaccacccagcucucccccgucaacaucugcacguuccggggcgacgugacccacaucaccggcagccacaacuacaccaugaaccuggccucccagaacuggaacaacuacgacccgacggaggagauccccgcgccccuggggacccccgacuucgugggcaagauccaggggguccucacccagaccacgcgcaccgacggcagcacccgggggcacaaggccaccguguacacgggcagcgccgacuucgccccgaagcugggccgcgugcaguucgagaccgacaccaaccacgacuucgaggccaaccagaacaccaaguucacgcccgucggggugauccaggacggcuccaccacccaccggaacgagccccagcagugggugcugcccagcuacuccgggcgcaacacccacaacguccaccucgccccggcgguggcccccacguuccccggcgagcagcugcuguucuuccggagcaccaugcccgggugcuccggcuacccgaacauggaccucgacugccugcugccccaggagugggugcaguacuucuaccaggaggccgcccccgcgcagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacgcuggcccccaugggcaacgggaccggccggcgccgcuga

SEQ ID NO: 11855 - RNA, 1617 nt, Artificial Sequence
  derived and/or modified sequence opt1 from VP1__Norovirus_and/or_Norovirus-like__KM982949
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgggacggacaccgaccacgacuucgaggccaaccagaacaccaaguucacccccgugggcgucauccaggacgggagcacgacccaccgcaacgagccccagcagugggugcugcccuccuacagcggccggaacaccccgaacgugcaccucgcccccgcggucgcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacguggcccuccugcgguucgucaacccggacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgguga

SEQ ID NO: 11856 - RNA, 1617 nt, Artificial Sequence
  derived and/or modified sequence opt1 from VP1__Norovirus_and/or_Norovirus-like__KM406485
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 11857 - RNA, 1617 nt, Artificial Sequence
  derived and/or modified sequence opt1 from VP1__Norovirus_and/or_Norovirus-like__KM198574
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcgacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11858 - RNA, 1617 nt, Artificial Sequence
  derived and/or modified sequence opt1 from VP1__Norovirus_and/or_Norovirus-like__KM198517
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaucaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccggggccuucgugguccagccccagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgacccgaccgaggagauccccgcgccccucggcacgcccgacuucguggggaagauccagggcguccugacccagaccaccaagggggacggcuccacgcggggccacaaggccaccguguacaccgggagcgccccguucacccccaagcugggcuccgugcaguucagcacggacaccgagaacgacuucgagacccaccagaacaccaaguucacgcccgucggggugauccaggacggcagcaccacccaccgcaacgagccccagcagugggugcucccguccuacagcgggcgggacauccacaacguccaccuggcccccgccguggcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 11859 - RNA, 1617 nt, Artificial Sequence
  derived and/or modified sequence opt1 from VP1__Norovirus_and/or_Norovirus-like__JX439839
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccacaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcgcggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccggaacgagccccagcagugggugcuccccuccuacagcgggcgcaacgucccgaacgugcaccuggcccccgccguggcgcccaccuuccccggcgagcagcuccucuucuuccgguccacgaugccgggcugcagcggguaccccaacauggaccuggacugccugcucccccaggaguggguccagcacuucuaccaggaggccgcccccgcccaguccgacguggcgcugcugcgcuucgugaacccggacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgguga

SEQ ID NO: 11860 - RNA, 1617 nt, Artificial Sequence
  derived and/or modified sequence opt1 from VP1__Norovirus_and/or_Norovirus-like__JX439837
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccgcaacgagccccagcagugggugcuccccagcuacuccgggcggaacguccagaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacgcucgcccccaugggcaacggcaccgggcgccggcgcuga

SEQ ID NO: 11861 - RNA, 1617 nt, Artificial Sequence
  derived and/or modified sequence opt1 from VP1__Norovirus_and/or_Norovirus-like__KC631815
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccaacuacuccgggcgggacagccacaacgugcaccucgccccggccguggcccccuccuuccccggcgagcagcugcuguucuuccgcagcacgaugcccgggugcuccggcuacccgaacaugaaccucgacugccugcugccccaggaguggguccagcacuucuaccaggaggccgcgcccgcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccgccgguga

SEQ ID NO: 11862 - RNA, 1617 nt, Artificial Sequence
  derived and/or modified sequence opt1 from VP1__Norovirus_and/or_Norovirus-like__KC409315
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgaggacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11863 - RNA, 1617 nt, Artificial Sequence
  derived and/or modified sequence opt1 from VP1__Norovirus_and/or_Norovirus-like__KC409289
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgacccgacggaggaggugcccgcgccccucggcacccccgacuucgucgggaagauccagggcgugcugacccagaccacgaagggggacggcuccacccggggccacaaggccaccguguacaccgggagcgccccguucacgcccaagcugggcuccguccaguucagcaccgacaccgagaacgacuucgagacccaccagaacacgaaguucacccccgugggggugauccaggacggcgggaccacccaccgcaacgagccccagcaguggguccucccgagcuacuccggccgggacgugcacaacgugcaccuggcccccgccgucgcgcccacguuccccggcgagcagcuccucuucuuccgcagcaccaugccggggugcuccggcuaccccaacauggaccuggacugccugcucccccaggagugggugcagcacuucuaccaggaggccgcccccgcccagagcgacguggcgcugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacgcucgcccccaugggcaacgggaccggccgccggcgcuga

SEQ ID NO: 11864 - RNA, 1617 nt, Artificial Sequence
  derived and/or modified sequence opt1 from VP1__Norovirus_and/or_Norovirus-like__KC409278
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgaggcccaccagaacaccaaguucacccccgucggggugauccaggacggcgggacgacccaccgcaacgagccccagcagugggugcuccccuccuacagcggccgggacguccacaacgugcaccuggccccggcgguggcccccaccuuccccggcgagcagcuccucuucuuccgcuccaccaugcccgggugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggaccggccgccggcgcuga

SEQ ID NO: 11865 - RNA, 1617 nt, Artificial Sequence
  derived and/or modified sequence opt1 from VP1__Norovirus_and/or_Norovirus-like__KC175402
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggccggaacgucccgaacgugcaccuggcccccgccguggcgcccaccuuccccggggagcagcuccucuucuuccgcagcacgaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 11866 - RNA, 1617 nt, Artificial Sequence
  derived and/or modified sequence opt1 from VP1__Norovirus_and/or_Norovirus-like__JX459616
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11867 - RNA, 1617 nt, Artificial Sequence
  derived and/or modified sequence opt1 from VP1__Norovirus_and/or_Norovirus-like__JX459599
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgcguucgugguccagccccagaacgggcgcugcaccaccgacggcgugcuccuggggaccacgcagcucucccccgucaacaucugcaccuuccggggcaacgugaccaacaucgccggcagccagaccuacacgaugaaccuggccucccagaacuggaacaacuacgacccgaccgaggagauccccgcgccccuggggacccccgacuucgugggccgcauccaggggguccucacccagacgacccggggcgacgggagcacccgcggccacaaggccaccgugagcacgggcuccgccuacuucaccccgaagcuggggagcgugcaguucuccaccgacaccagcacggacuucgagaccggccagaacacccgguucacccccgucgggguggugcaggacggcuccacgacccacaagaacgagccccagcaguggguccugcccagcuacuccgggcgcgacagccacaacgugcaccucgccccggccguggcccccaccuuccccggcgagcagauccuguucuuccgguccaccaugcccggcugcagcggguacccgaacauggaccuggacugccuccugccccaggaguggguccagcacuucuaccaggaguccgcccccgcgcagagcgacguggcccugcuccgcuucgugaaccccgacaccggccggguccuguucgagugcaagcugcacaaguccggguacgugacgguggcccacaccggccagcacgaccucgucaucccgcccaacggguacuuccgcuucgacagcugggugaaccaguucuacacccuggcccccaugggcaacggcgcggggcggcgccgcuga

SEQ ID NO: 11868 - RNA, 1617 nt, Artificial Sequence
  derived and/or modified sequence opt1 from VP1__Norovirus_and/or_Norovirus-like__JN400603
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaucaccaagggcgacggguccacccggggccacaaggccacgguguacaccggcggggcccccuucaccccgaagcugggcagcgugcaguucagcaccgacacggagaacgacuucgagacccaccagaacaccaaguucacccccgucggggugauccaggacggcuccacgacccaccgcaacgagccccagcagugggugcuccccagcuacuccgggcggaacguccacaacgugcaccuggccccggccguggcgcccaccuuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11869 - RNA, 1617 nt, Artificial Sequence
  derived and/or modified sequence opt1 from VP1__Norovirus_and/or_Norovirus-like__JQ613572
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagacccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggaugcugacccagaccacgcagggcgacggguccacccggggccacaaggccaccgucuacaccggcagcgccgacuucacgcccaagcuggggagcgugcaguucgccaccgacaccgagaacgacuucgagacccaccagaacacgaaguucaccccggugggcgucauccaggacggguccaccacccaccgcaacgagccccagcagugggcccuccccagcuacuccggccggagcgcgcacaacgugcaccuggcccccgccguggccccgaacuuccccggggagcagcuccucuucuuccgcuccacgaugcccggcugcagcggcuaccccaacauggaccuggacugccugcucccgcaggaguggguccagcacuucuaccaggaggcggcccccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcgcccauggggaacggcacgggccgccggcgcuga

SEQ ID NO: 11870 - RNA, 1617 nt, Artificial Sequence
  derived and/or modified sequence opt1 from VP1__Norovirus_and/or_Norovirus-like__JQ613525
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucuccacggacaccgagaacgacuucgagacccaccagaacaccaaguucacgccggucggcgugauccaggacgggagcaccacccaccgcaacgagccccagcagugggugcuccccuccuacagcggccggaacguccacaacgugcaccuggcccccgccguggcgccgaacuuccccggggagcagcuccucuucuuccgcuccaccaugcccggcugcagcggcuaccccaacauggaccuggacugccugcucccgcaggaguggguccagcacuucuaccaggaggccgcccccgcccaguccgacguggcgcugcugcgguucgugaaccccgacacggggcgcguccucuucgagugcaagcugcacaagcccggcuacgugaccguggcccacaccgggcagcacgaccuggucaucccgcccaacggcuacuuccgguucgacagcugggugaaccaguucuacacccucgcccccauggggaacggcgccggccgccggcgcuga

SEQ ID NO: 11871 - RNA, 1617 nt, Artificial Sequence
  derived and/or modified sequence opt1 from VP1__Norovirus_and/or_Norovirus-like__JQ613510
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacgccaugaaccuggcgagccugaacuggaacaacuacgaccccaccgaggagaucccggcgccccucgggacccccgacuucgugggcaagauccaggggcugcugacgcagaccaccaagggcgacggguccacccggggccacaaggccacggucuacaccggcagcgcccccuucaccccgaagcucgggagcgugcaguucuccaccgacacggagaacgacuucgagacccaccagaacaccaaguucacccccgugggcgucauccaggacgggagcacgacccaccgcaacgagccccagcagugggugcugcccuccuacagcggccggaacgugcacaacguccaccuggccccggccguggcccccaccuuccccggggagcagcuccuguucuuccgcuccaccaugcccggcugcagcggcuacccgaacauggaccuggacugccuccugccccaggagugggugcagcacuucuaccaggaggccgcccccgcgcaguccgacgucgcccugcuccgguucgugaaccccgacacggggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccauggggaacggcaccggccgccggcgcuga

SEQ ID NO: 11872 - RNA, 1617 nt, Artificial Sequence
  derived and/or modified sequence opt1 from VP1__Norovirus_and/or_Norovirus-like__GQ856450
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccagcaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcacccacaacuacaccaugaaccuggccagccugaacuggaacaacuacgaccccacggaggagaucccggcgccccucgggacccccgacuucgugggcaagauccaggggguccugacccagaccacgaagggcgacggguccacccgcggccacaaggccaccguguacaccggcagcgcccccuucacgccgaagcuggggagcgugcaguucuccaccgacaccgagaacgacuucgagacccaccagaacacgaaguucacccccgucggcgugauccaggacgggagcaccacccaccggaacgagccccagcagugggugcuccccuccuacagcggcgggaacguccagaacgugcaccuggccccggccguggcgcccacguuccccggcgagcagcuccucuucuuccgcuccaccaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacgcucgcccccaugggcaacggcaccgggcgccggcgcuga

SEQ ID NO: 11873 - RNA, 1617 nt, Artificial Sequence
  derived and/or modified sequence opt1 from VP1__Norovirus_and/or_Norovirus-like__AB541296
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugauccacaucgccgggagccgcaacuacaccaugaaccuggccgcgcugaacuggaacaacuacgaccccaccgaggagaucccggcgccccucggcacccccgacuucguggggaagauccagggcguccugacgcagaccaccaagggggacggcuccacccggggccacaaggccacgguguacaccgggagcgccgacuucacccccaagcugggcuccgugcaguucagcaccgacacggagaacgacuucgagacccaccagaacaccaaguucaccccggucggggugauccaggacggcagcacgacccaccgcaacgagccccagcagugggugcuccccuccuacagcgggcggaacguccacaacgugcaccuggcccccgccguggccccgaccuuccccggcgagcagcuccucuucuuccgcuccaccaugcccggcugcagcggguaccccaacauggaccuggacugccugcucccgcaggaguggguccagcacuucuaccaggaggccgcccccgcgcaguccgacguggcccugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcuga

SEQ ID NO: 11874 - RNA, 1617 nt, Artificial Sequence
  derived and/or modified sequence opt1 from VP1__Norovirus_and/or_Norovirus-like__AB541212
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcgcuucuccacggacaccgagaacgacuucgagacccaccagaacaccaaguucacgcccgucggcgugauccaggacgggagcaccacccaccggaacgagccccagcagugggugcuccccuccuacagcggccgcgacguccacaacgugcaccuggccccggccguggcgcccaccuuccccggggagcagcuccucuucuuccgguccacgaugcccggcugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcacaagccgggcuacgugaccguggcccacaccgggcagcacgaccuggucaucccgcccaacggcuacuuccgcuucgacagcugggugaaccaguucuacacccucgcccccauggggaacggcacgggccggcgccgcuga

SEQ ID NO: 11875 - RNA, 1617 nt, Artificial Sequence
  derived and/or modified sequence opt1 from VP1__Norovirus_and/or_Norovirus-like__AB504321
augaagauggccagcaacgacgccaaccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcggggccuucguggugcagccgcagaacggccgcugcacgaccgacgggguccugcugggcaccacccagcucucccccgugaacaucugcacguuccggggcgacgucacccacaucgccgggacccgcaacuacaccaugaaccuggccagccugaacuggaacaacuacgaccccacggaggagaucccggcgccccucggcacccccgacuucguggggaagauccagggcgugcugacccagaccacgaagggggacggcuccacccggggccacaaggccaccgucuacaccgggagcgcccccuucacgccgaagcugggcuccgugcaguucagcaccgacaccgagaacgacuucgagacccaccagaacacgaaguucacccccgugggggucauccaggacggcgggaccacccaccgcaacgagccccagcagugggugcuccccagcuacuccggccggaacgugcacaacguccaccuggccccggccguggcgcccacguuccccggcgagcagcuccucuucuuccgcagcaccaugcccgggugcuccggcuacccgaacauggaccuggacugccugcucccccaggagugggugcagcacuucuaccaggaggccgcccccgcccagagcgacgucgcgcugaugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccaugggcaacgggaccggccgccggcgcuga

SEQ ID NO: 11876 - RNA, 1617 nt, Artificial Sequence
  derived and/or modified sequence opt1 from VP1__Norovirus_and/or_Norovirus-like__AB294785
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgacccgccgggacggcuccacccgcgggcacaaggccaccgugagcacgggcagcgugcacuucacccccaagcugggcuccguccaguucagcaccgacaccuccaacgacuucgagacggggcagaacacccgguucaccccggugggcgugguccaggacgggagcaccacgcaccagaacgagccccagcagugggugcugcccaacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcaagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcuga

SEQ ID NO: 11877 - RNA, 1617 nt, Artificial Sequence
  derived and/or modified sequence opt1 from VP1__Norovirus_and/or_Norovirus-like__AB294780
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgaccaagggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccgcacggggcacaacguccaccucgccccggccguggcccccaccuuccccggcgagcagcugcuguucuuccggagcaccaugcccgggugcuccggcuacccgaacaugaaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacacgggccagcacgaccuggugaucccgcccaacggguacuuccgcuucgacagcugggucaaccaguucuacacccuggcgcccaugggcaacgggaccggccggcgccgguga

SEQ ID NO: 11878 - RNA, 1617 nt, Artificial Sequence
  derived and/or modified sequence opt1 from VP1__Norovirus_and/or_Norovirus-like__AB303933
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcaccaagcccuucaccguccccauccugaccguggaggagaugacgaacagccgguuccccaucccccuggagaagcuguucaccggcccguccggggccuucgugguccagccccagaacggccgcugcaccaccgacggggugcuccugggcacgacccagcucagccccgucaacaucugcaccuuccggggcgacgugacccacaucgccgggacgcacaacuacaccaugaaccuggccucccagaacuggaacaacuacgacccgaccgaggagauccccgcgccccugggcacccccgacuucguggggcgcauccagggcaugcucacgcagaccacccgcggggacggcagcacccggggccacaaggccacggucuccaccggggacgugcacuucaccccgaagcugggcagcauccaguucaacaccgacacgaacaacgacuucgagaccgggcagaacaccaaguucacccccgugggcgucgugcaggacgggaacggcacgcaccagaacgagccccagcagugggugcugcccuccuacagcggccggaccgggcacaacguccaccucgccccggccguggcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacgucgcccuccugcgguucgugaaccccgacaccgggcgcgugcuguucgagugcaagcuccacaaguccggcuaccugacggucgcccacaccggccagcacgaccuggugaucccgcccaacggguacuuccgguucgacagcugggugaaccaguucuacacccucgcgcccaugggcaacgggaccggccgccggcgcuga

SEQ ID NO: 11879 - RNA, 1617 nt, Artificial Sequence
  derived and/or modified sequence opt1 from VP1__Norovirus_and/or_Norovirus-like__AY587988
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcgccuuccggggcgacgugacccacaucgccgggacccacaacuacaccaugaaccuggccucccagaacuggaacaacuacgacccgacggaggagauccccgcgccccugggcacccccgacuucguggggcgcauccagggcaugcucacccagaccacgcgcggggacggcagcacccggggccacaaggccaccgucuccaccggggacgugcacuucacgccgaagcugggcagcauccaguucaacaccgacaccaacaacgacuucgagaccgggcagaacacgaaguucacccccgugggcgucgugcaggacgggaacggcacccaccagaacgagccccagcagugggugcugcccuccuacagcggccggaccgggcacaacguccaccucgccccggccguggcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaagaccggcuacgucaccguggcgcacacgggccagcacgaccuggugaucccgcccaacggguacuuccgguucgacuccugggucaaccaguucuacacccuggcccccaugggcaacgggaccggccgccggcgcuga

SEQ ID NO: 11880 - RNA, 1617 nt, Artificial Sequence
  derived and/or modified sequence opt1 from VP1__Norovirus_and/or_Norovirus-like__KX354103
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagcgccucuucaccggcccguccagcgccuucgucgugcagccccagaacgggcggugcaccacggacggcgugcugcuggggaccacccagcucucccccgucaacaucugcaccuuccgcggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgaguucgccccgaagcugggccgggugcaguucgagacggacaccaaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacaucaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 11881 - RNA, 1617 nt, Artificial Sequence
  derived and/or modified sequence opt1 from VP1__Norovirus_and/or_Norovirus-like__KX354048
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacaccgaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 11882 - RNA, 1617 nt, Artificial Sequence
  derived and/or modified sequence opt1 from VP1__Norovirus_and/or_Norovirus-like__KX354047
augaagauggccagcuccgacgccagccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacacccacaacguccaccucgccccggcgguggcccccaccuuccccggcgagcagcugcuguucuuccgcuccacgaugcccgggugcagcggcuacccgaacauggaccucgacugccugcugccccaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacggggccggccgccgccgguga

SEQ ID NO: 11883 - RNA, 1617 nt, Artificial Sequence
  derived and/or modified sequence opt1 from VP1__Norovirus_and/or_Norovirus-like__KU985161
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgccacggacaccgaccacgacuucgaggccaaccagaacaccaaguucacccccgucggggugauccaggacggcuccacgacccaccggaacgagccccagcagugggugcugcccagcuacuccgggcgcaacacccacaacguccaccucgcgccggccguggcccccaccuuccccggcgagcagcugcuguucuuccggagcacgaugcccgggugcuccggcuacccgaacauggaccucgacugccugcugccccaggagugggugcaguacuucuaccaggaggccgcgcccgcccagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccggcgccgcuga

SEQ ID NO: 11884 - RNA, 1617 nt, Artificial Sequence
  derived and/or modified sequence opt1 from VP1__Norovirus_and/or_Norovirus-like__AB972517
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcagcacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 11885 - RNA, 1617 nt, Artificial Sequence
  derived and/or modified sequence opt1 from VP1__Norovirus_and/or_Norovirus-like__AB972494
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccaacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 11886 - RNA, 1617 nt, Artificial Sequence
  derived and/or modified sequence opt1 from VP1__Norovirus_and/or_Norovirus-like__KU311163
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaaggacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccaacgccuucgugguccagccgcagaacgggcgcugcacgaccgacggcgugcuccuggggaccacccagcucagccccgucaacaucugcacguuccggggcgacgugacccagaucgccuccacccagaccuacacgaugaaccuggccagccugaacuggaacaacuacgaccccaccgaggagaucccggcgccccucggcgcccccgacuucauggggaagauccagggcgugcugacccagaccacgcgccaggacggguccacccggggccacaaggccaccgucagcaccgggagcgugcacuucacgcccaagcugggcuccgugcgcuucgacaccgacaccaacaacaaccuccagccgcaccagagcacccgguucacgcccgucggcgugauccaggacggggacacccaccagaacgagccccagcagugggugcugcccugcuacuccggccgcgacgucaacaacgugcaccuggccccggccguggcgcccagcuuccccggggagcagcuccuguucuuccgguccaccaugcccggcugcagcggguacccgaacauggaccuggacugccuccugccccaggaguggguccagcacuucuaccaggaggccgcccccgcccaguccgacguggcgcugcuccgcuucgugaaccccgacaccggccggguccuguucgagugcaagcugcacaagagcggcuacgugacgguggcccacaccgggcagcacaaccucgucaucccgcccaacggcuacuuccgcuucgacuccugggugaaccaguucuacacccuggcccccauggggaacggcaccgggcggcgccgcguguga

SEQ ID NO: 11887 - RNA, 1617 nt, Artificial Sequence
  derived and/or modified sequence opt1 from VP1__Norovirus_and/or_Norovirus-like__KR904236
augaagauggccagcuccgacgccaacagcuccgacggcagcgcggccaaccuggugcccgaggucaacaacgaggugauggcccucgagccgguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccugggccccgaccucaacccguaccugucccaccuggcccgcauguacaacggcuacgccgggggcuucgaggugcaggucauccucgccgggaacgccuucaccgccggcaagaucaucuucgccgccgugccgcccaacuuccccacggaggggcugagccccucccaggugaccauguucccccacaucaucgucgacgugcggcagcuggagcccgugcucaucccccugccggacguccgcaacaacuucuaccacuacaaccagagcaacgaccccaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccauccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacgugacgcacaucaccggcucccgcaacuacaccaugaaccuggccacccagaacuggaacagcuacgaccccacggaggagaucccggcgccccuggggacccccgacuucgugggcaagauccaggggguccucacccagaccacgaagaccgacggcagcacccgggggcacaaggccaccguguacacgggcuccgccgacuucgcccccaagcugggccgcgugcaguucgccaccgacaccgacaacgacuucgaggccaaccagaacaccaaguucacgccggucggggugauccaggacggcgggaccacccaccggaacgagccccagcagugggugcugcccagcuacuccggccgcaacacccacaacguccaccucgcgcccgccguggccccgacguuccccggggagcagcugcuguucuuccggagcaccaugcccggcugcuccggcuaccccaacauggaccucgacugccugcugccgcaggagugggugcaguacuucuaccaggaggccgcgcccgcccagagcgacgucgcccuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacgcuggcccccauggggaacggcaccggccggcgccgcuga

SEQ ID NO: 11888 - RNA, 1617 nt, Artificial Sequence
  derived and/or modified sequence opt1 from VP1__Norovirus_and/or_Norovirus-like__KR904225
augaagauggccagcuccgacgccaaccccagcgagggcuccaccgcgagccuggugccggaggucaacaacgaggugauggcccucgagcccguggccggggccgccaucgcggcccccgucgccggccaggugaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgagcccaccaucaagcugguggccaugcucuacacgccccugcgggcgaacaacgccggcgacgacguguucaccgucuccugccgcgugcugacccggccgagccccgacuucgacuucaucuuccucgugccgcccaccgucgagucccgcacgaagcccuucagcgugcccauccugaccguggaggagaugaccaacucccgguuccccaucccccuggagaagcuguucaccggcccgagcuccagcuucgucgugcagccccagaacgggcgcugcacgaccgacggcguccuccuggggaccacccagcucucccccgugaacaucugcacguuccggggcgacgugacccacaucagcggcagccgcaaccacaccaugaaccuggccucccagaacuggaacagcuacgacccgaccgaggagauccccgcgccccuggggacgcccgacuucgucggcaagauccagggggugcucacccagaccacccgguccgacggcagcacgcgcgggcacaaggccaccguguacaccggcuccgccgacuucagcccgaagcugggccggauccaguucgccaccgacacggacaacgacuucgagaccaaccagaacaccaaguucacccccgucggggugauccaggacggcgggacgacccaccgcaacgagccccagcagugggugcugcccaccuacuccggccggaacacccacaacguccaccucgccccggccguggcccccacguuccccggggagcagcugcuguucuuccgcagcaccaugcccggcugcuccggcuacccggacauggaccucgacugccugcugccccaggagugggugcagcacuucuaccaggaggcggcccccgcccagagcgacgucgcccuccugcgguucgugaaccccgacaccgggcgcgugcuguucgagugcaagcuccacaaggcgggcuacgucaccguggcccacaccgggcagcacgaccuggugaucccgcccaacggcuacuuccgguucgacuccugggucaaccaguucuucacgcuggcccccauggggaacggcaccggccgccgccgguga

SEQ ID NO: 11889 - RNA, 1617 nt, Artificial Sequence
  derived and/or modified sequence opt1 from VP1__Norovirus_and/or_Norovirus-like__LC005710
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccacccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcgacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcgcuucuccaccgacaccgagaacgacuucgagacccaccagaacacgaaguucacccccgucggcgugauccaggacgggagcaccacccaccggaacgagccccagcagugggugcuccccuccuacagcggccgcgacguccacaacgugcaccuggccccggccguggcgcccacguuccccggggagcagcuccucuucuuccgguccaccaugcccggcugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcacaagagcggcuacgugaccguggcccacaccgggcagcacgaccuggucaucccgcccaacggcuacuuccgcuucgacuccugggugaaccaguucuacacgcucgcccccauggggaacggcaccggccggcgccgcuga

SEQ ID NO: 11890 - RNA, 1617 nt, Artificial Sequence
  derived and/or modified sequence opt1 from VP1__Norovirus_and/or_Norovirus-like__LC018709
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccggcgagagccgcaccaagcccuucuccgugcccgugcugacggucgaggagaugaccaacagccgguuccccaucccccuggagaagcuguucaccgggccguccagcgccuucgugguccagccccagaacggccgcugcaccacggacggggugcugcugggcaccacccagcucucccccgugaacaucugcaccuuccggggcgacgucacgcacaccaccgggagccacaacuacaccaugaaccuggccucccagaacuggaacaacuacgacccgacggaggagauccccgcgccccugggcacccccgacuucguggggaagauccagggcaugcucacccagaccacgcgcaccgacgggagcacccggggccacaaggccaccguguacacgggcagcgccgacuucgccccgaagcuggggcgcguccaguucggcaccgacaccgaccacgaccuggaggccaaccagaacaccaaguucacgcccgugggggugauccaggacggcuccaccacccaccggaacgagccccagcaguggguccuccccagcuacuccgggcgcaacaccccgaacgugcaccuggcccccgcgguggcccccacguuccccggcgagcagcuccucuucuuccggagcaccaugccgggcugcuccggguaccccaacauggaccuggacugccugcucccccaggaguggguccaguacuucuaccaggaggccgcccccgcgcagagcgacguggcccugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacgcucgcccccaugggcaacggcaccgggcggcgccgcuga

SEQ ID NO: 11891 - RNA, 1617 nt, Artificial Sequence
  derived and/or modified sequence opt1 from VP1__Norovirus_and/or_Norovirus-like__KM198587
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaaggaggacgggagcacccggggccacaaggccaccguguacaccggcuccgcccccuucacgccgaagcuggggagcgugcaguucagcaccgacaccgagaacgacuucgagacccaccagaacacgaaguucacccccgucggcgugauccaggacgggggcaccacccaccgcaacgagccccagcagugggugcuccccuccuacagcgggcgggacguccacaacgugcaccuggccccggccguggcgcccacguuccccggcgagcagcuccucuucuuccgcuccaccaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacgcucgcccccaugggcaacggcaccgggcgccggcgcuga

SEQ ID NO: 11892 - RNA, 1617 nt, Artificial Sequence
  derived and/or modified sequence opt1 from VP1__Norovirus_and/or_Norovirus-like__KM198560
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgaggcccaccagaacaccaaguucacccccgugggggucauccaggacggcgggacgacccaccgcaacgagccccagcagugggugcuccccuccuacagcggccgggacgugcacaacguccaccuggccccggcgguggcccccaccuuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacacggggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccaugggcaacgggaccggccgccggcgcuga

SEQ ID NO: 11893 - RNA, 1617 nt, Artificial Sequence
  derived and/or modified sequence opt1 from VP1__Norovirus_and/or_Norovirus-like__KM198521
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcgccuuccggggcgacgugacccacaucgccgggagccgcaacuacaccaugaaccuggcgucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccgggacguccacaacgugcaccuggccccggccguggcccccaccuuccccggcgagcagcuccucuucuuccgcuccacgaugcccgggugcagcggcuacccgaacauggaccuggacugccugcucccccaggaguggguccagcacuucuaccaggaggccgcccccgcgcaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11894 - RNA, 1617 nt, Artificial Sequence
  derived and/or modified sequence opt1 from VP1__Norovirus_and/or_Norovirus-like__KM198490
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacaucacccacaucgccgggagccgcgacuacaccaugaaccuggccucccugaacuggaacaacuacgaccccacggaggagaucccggcgccccucggcacccccgacuucguggggaagauccagggcgugcugacccagaccacgaagcgggacgggagcacccgcggccacaaggccaccgucuacaccggcuccgcccccuucacgccgaagcuggggagcgugcgguucagcaccgacaccgagaacgacuucgagacccaccagaacacgaaguucacccccgugggcgucauccaggacggguccaccacccaccgcaacgagccccagcagugggugcuccccagcuacuccggccgggacgugcacaacguccaccuggccccggccguggcgcccacguuccccggggagcagcuccucuucuuccgcagcaccaugcccggcugcuccggcuacccgaacauggaccuggacugccugcucccccaggagugggugcagcacuucuaccaggaggccgcccccgcccagagcgacgucgcgcugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacgcucgcccccauggggaacggcaccggccgccgccgguga

SEQ ID NO: 11895 - RNA, 1617 nt, Artificial Sequence
  derived and/or modified sequence opt1 from VP1__Norovirus_and/or_Norovirus-like__KC409241
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacggacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacccaccgcaacgagccccagcaguggguccugccguccuacagcgggcgggacgugcacaacgugcaccucgcccccgccgucgcccccaccuuccccggcgagcagcugcuguucuuccgcuccacgaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacccuggcccccaugggcaacgggacgggccgccgccgguga

SEQ ID NO: 11896 - RNA, 1617 nt, Artificial Sequence
  derived and/or modified sequence opt1 from VP1__Norovirus_and/or_Norovirus-like__JX459625
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcuccgugcaguucagcaccgacaccgagaacgacuucgagacccaccagaacacgaaguucacccccgucggggugauccaggacggcgggaccacccaccgcaacgagccccagcagugggugcuccccagcuacuccggccggaacguccacaacgugcaccuggccccggccguggcgcccacguuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugaugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacgcuggcccccaugggcaacgggaccggccgccggcgcuga

SEQ ID NO: 11897 - RNA, 1617 nt, Artificial Sequence
  derived and/or modified sequence opt1 from VP1__Norovirus_and/or_Norovirus-like__JX459613
augaagauggccagcaacgacgcccaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11898 - RNA, 1617 nt, Artificial Sequence
  derived and/or modified sequence opt1 from VP1__Norovirus_and/or_Norovirus-like__JX459600
augaagauggccagcaacgacgccaaccccuccgacggcagcgcggcccaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11899 - RNA, 1617 nt, Artificial Sequence
  derived and/or modified sequence opt1 from VP1__Norovirus_and/or_Norovirus-like__JX459596
augaagauggccagcaacgacgcccaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcagacgauccucgccgggaacgccuucaccgcgggcaagaucaucuucgccgccgucccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgaccccacgaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucaccgugcccauccugaccgucgaggagaugacgaacagccgguuccccaucccccuggagaagcuguucaccggcccguccagcgccuucguggugcagccccagaacgggcgcugcaccaccgacggcguccuccuggggacgacccagcucucccccgugaacaucugcaccuuccggggcgacgucacccacaucgccggcacgcacaacuacaccaugaaccuggccagccagaacuggaacaacuacgacccgaccgaggagauccccgcgccccuggggacccccgacuucgugggccgcauccaggggaugcucacgcagaccacccggggcgacggguccacccgcggccacaaggccacggugagcaccggcgacguccacuucaccccgaagcugggguccauccaguucaacaccgacacgaacaacgacuucgagaccggccagaacaccaaguucacccccgugggggugguccaggacggcaacgggacgcaccagaacgagccccagcagugggugcugcccagcuacagcggccggaccggccacaacgugcaccucgccccggccgucgcccccaccuuccccggggagcagcugcuguucuuccgcuccaccaugcccggcugcagcggguacccgaacaugaaccucgacugccugcugccccaggagugggugcagcacuucuaccaggaggccgcgcccgcccaguccgacguggcccuccugcgguucgucaaccccgacaccggccgcgugcuguucgagugcaagcuccacaagagcggguacgugacggucgcccacaccggccagcacgaccuggugaucccgcccaacggcuacuuccgguucgacuccugggugaaccaguucuacacccuggcgcccauggggaacggcaccgggcgccggcgcuga

SEQ ID NO: 11900 - RNA, 1617 nt, Artificial Sequence
  derived and/or modified sequence opt1 from VP1__Norovirus_and/or_Norovirus-like__JX155749
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaagcccggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11901 - RNA, 1617 nt, Artificial Sequence
  derived and/or modified sequence opt1 from VP1__Norovirus_and/or_Norovirus-like__JQ613511
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcuccgaccccaccaucaagcugaucgccaugcucuacacgccccugcgggccaacaacgcgggggacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacggccgcugcacgaccgacggggugcuccugggcaccacccagcucucccccgucaacaucugcacguuccgcggggacgugacccacaucgccggcacccaggaguacaccaugaaccuggccagccagaacuggaacaacuacgacccgacggaggagauccccgcgccccugggcacccccgacuucguggggaagauccagggcguccucacccagaccacgcggcgggacgggagcacccgcggccacaaggccaccguguccaccgggagcgugcacuucacgccgaagcugggccggauccaguucuccaccgacaccagcaacgacuucgagaccggccagaacacgcgcuucacccccgucgggguggugcaggacggcuccaccacccaccagaacgagccccagcaguggguccugcccaacuacagcgggcgggacucccacaacgugcaccucgccccggccguggcccccagcuuccccggcgagcagcugcuguucuuccgcuccacgaugcccgggugcagcggcuacccgaacauggaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacgggacgggccgccgccgguga

SEQ ID NO: 11902 - RNA, 1617 nt, Artificial Sequence
  derived and/or modified sequence opt1 from VP1__Norovirus_and/or_Norovirus-like__HM802547
augaagauggccagcuccgacgccagccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucuccggcagccgcaacuaccggaugaaccuggccagccagaacuggaacaacuacgaccccaccgaggagaucccggcgccccuggggacccccgacuucgugggcaagauccaggggaugcucacgcagaccaccaagggcgacggguccacccgcggccacaaggccacggucagcaccggcuccguggacuucacccccaagcuggggagcgugcaguucgccaccgacacggacaacgacuucgagaccggccagaacacccgguucaccccggucggggugauccaggacggcuccagcgcccaccgcaacgagccccagcagugggugcugcccgacuacuccgggcggacgguccacaacgugcaccucgcccccgccguggcgccgaccuuccccggcgagcagcugcuguucuuccgcagcaccaugcccggcugcuccggguaccccaacauggaccucgacugccugcugccgcaggaguggguccagcacuucuaccaggaggccgcccccagccaguccgacguggcccuccugcgguucgugaaccccgacaccggccgcguccuguucgagugcaagcuccacaaggcgggguacgugacgguggcccacaccggccagcacgaccuggucaucccgcccaacggguacuuccgguucgacagcugggugaaccaguucuacacccuggcccccaugggcaacggcgccgggcgccgccgguga

SEQ ID NO: 11903 - RNA, 1617 nt, Artificial Sequence
  derived and/or modified sequence opt1 from VP1__Norovirus_and/or_Norovirus-like__HM802544
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgacccgccgggacggcuccacccgcgggcacaaggccaccgugagcacgggcagcgugcacuucacccccaagcugggcuccguccaguucagcaccgacaccuccaacgacuucgagacggggcagaacacccgguucaccccggugggcgugguccaggacgggagcaccacgcaccagaacgagccccagcagugggugcugcccgacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcaagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcuga

SEQ ID NO: 11904 - RNA, 1617 nt, Artificial Sequence
  derived and/or modified sequence opt1 from VP1__Norovirus_and/or_Norovirus-like__GQ856456
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucggcgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccgggcccagcuccgccuucgugguccagccgcagaacggccgcugcacgaccgacggggugcugcugggcaccacccagcucagccccgucaacaucugcacguucaagggcgacgugacccacaucgccgggucccggaacuacaccaugaaccuggccagccugaacuggaacaacuacgaccccaccgaggagaucccggcgccccucggcacgcccgacuucguggggaagauccagggcguccugacccagaccaccaagggggacggcuccacgcgcggccacaaggccaccguguacaccgggagcgcccccuucaccccgaagcugggcagcgugcaguucuccacggacaccgagaacgacuucgagacccaccagaacaccaaguucacgcccgucggggugauccaggacggcgggaccacccaccggaacgagccccagcagugggugcuccccagcuacuccggccgcaacguccagaacgugcaccuggccccggccguggcgcccaccuuccccggcgagcagcuccucuucuuccggagcacgaugcccgggugcuccggcuacccgaacauggaccuggacugccugcucccccaggaguggguccagcacuucuaccaggaggccgcccccgcccagagcgacguggcgcugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccaugggcaacgggacgggccggcgccgguga

SEQ ID NO: 11905 - RNA, 1617 nt, Artificial Sequence
  derived and/or modified sequence opt1 from VP1__Norovirus_and/or_Norovirus-like__AB541332
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccgggggcgcccccuucacgccgaagcugggguccgcccaguucagcaccgacaccgagaacgacuucgagacccaccagaacacgaaguucacccccgugggcgucauccaggacgggggcaccacccaccgcaacgagccccagcagugggugcuccccagcuacuccggccggaacgugcacaacguccaccuggccccggcgguggcccccacguuccccggggagcagcuccucuucuuccgcagcaccaugcccggcugcuccggguacccgaacauggaccuggacugccugcucccccaggagugggugcagcacuucuaccaggaggccgcccccgcgcagagcgacgucgcccugcugcgguucgugaaccccgacaccggccgcguccucuucgagugcaagcugcacaaguccggguacgugaccguggcccacaccggccagcacgaccuggugaucccgcccaacggcuacuuccgguucgacagcugggucaaccaguucuacacgcucgcccccauggggaacggcaccgggcgccggcgcuga

SEQ ID NO: 11906 - RNA, 1617 nt, Artificial Sequence
  derived and/or modified sequence opt1 from VP1__Norovirus_and/or_Norovirus-like__AB541316
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccauggaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11907 - RNA, 1617 nt, Artificial Sequence
  derived and/or modified sequence opt1 from VP1__Norovirus_and/or_Norovirus-like__AB541238
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccgggacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11908 - RNA, 1617 nt, Artificial Sequence
  derived and/or modified sequence opt1 from VP1__Norovirus_and/or_Norovirus-like__AB535750
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugggccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccgggcccuccagcgccuucgugguccagccgcagaacggccgcugcacgaccgacggggugcugcugggcaccacccagcucucccccgucaacaucugcacguuccggggcgacgugacccgcaucgccgggagccggaacuacaccaugaaccuggccucccugaacuggaacaacuacgaccccaccgaggagaucccggcgccccucggcacgcccgacuucguggggaagauccagggcguccugacccagaccaccaagggggacggcagcacgcgcggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccggaacgagccccagcagugggugcuccccuccuacagcggccgcaacgucccgaacgugcaccuggcccccgccguggcgcccaccuuccccggcgagcagcuccucuucuuccgguccacgaugccggggugcagcggcuaccccaacauggaccuggacugccugcucccccaggaguggguccagcacuucuaccaggaggccgcccccgcccaguccgacguggcgcugcugcgcuucgugaacccggacaccgggcggguccucuucgagugcaagcugcacaagagcggcuacgugaccguggcccacaccgggcagcacgaccuggucaucccgcccaacggcuacuuccgcuucgacuccugggugaaccaguucuacacccucgcccccaugggcaacgggacgggccggcgccgcuga

SEQ ID NO: 11909 - RNA, 1617 nt, Artificial Sequence
  derived and/or modified sequence opt1 from VP1__Norovirus_and/or_Norovirus-like__FJ538900
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccggccgaggagauccccgcgccccugggcacccccgacuucguggggcgcauccagggcguccucacccagaccacgcgcggggacggcagcacccggggccacaaggccaccguguccaccggggacgugcacuucacgccgaagcugggcagcauccaguucaacaccgacaccaacaacgacuucgagaccgggcagaacacgaaguucacccccgucggcguggugcaggacgggaacggcacccaccagaacgagccccagcaguggguccugcccuccuacagcggccggaccgggcacaacgugcaccucgccccggccguggcccccacguuccccggcgagcagcugcuguucuuccgcagcaccaugcccgggugcuccggcuacccgaacaugaaccucgacugccugcugccccaggaguggguccagcacuucuaccaggaggcggcccccgcccagagcgacguggcccuccugcgguucgugaaccccgacaccgggcgcguccuguucgagugcaagcuccacaaguccggcuacgugaccguggcgcacaccggccagcacgaccuggucaucccgcccaacggguacuuccgguucgacagcugggugaaccaguucuacacgcuggcccccaugggcaacgggaccggccgccggcgcuga

SEQ ID NO: 11910 - RNA, 1617 nt, Artificial Sequence
  derived and/or modified sequence opt1 from VP1__Norovirus_and/or_Norovirus-like__EU876889
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcgggaccacccaccagaacgagccccagcaguggguccugcccaacuacagcggccgggacucccacaacgugcaccucgccccggccguggcccccagcuuccccggggagcagcugcuguucuuccgcuccacgaugcccggcugcagcggcuacccgaacaugaaccucgacugccugcugccccaggaguggguccagcacuucuaccaggaggccgcgcccgcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgguga

SEQ ID NO: 11911 - RNA, 1617 nt, Artificial Sequence
  derived and/or modified sequence opt1 from VP1__Norovirus_and/or_Norovirus-like__EU876887
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccuccuacagcgggcgggacucccacaacgugcaccucgccccggccguggcccccagcuuccccggcgagcagcugcuguucuuccgcuccacgaugcccgggugcagcggcuacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacggggccggccgccgccgguga

SEQ ID NO: 11912 - RNA, 1617 nt, Artificial Sequence
  derived and/or modified sequence opt1 from VP1__Norovirus_and/or_Norovirus-like__FJ411171
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaugaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggagcaacuacgaccccacggaggagaucccggcgccccuggggacccccgacuucgugggcaagauccaggggaugcucacccagaccacgcgccgggacggcuccacccgcgggcacaaggccaccguccugaccggcagcgccgacuucgcccccaagcugggccgggugcaguucgccacggacaccgacaacgacuucgagagcggggagaacaccaaguucaccccggugggcgucauccaggacggguccacgacccaccgcaacgagccccagcagugggugcuccccaacuacagcggccggaccgggcacaacgugcaccuggcgcccgccgucgccccgaccuaccccggcgagcagcuccucuucuuccgcuccacgaugcccggcugcagcggguaccccaacauggaccuggacugccugcucccgcaggagugggugcggcacuucuaccaggaggccgcgcccgcccaguccgacguggcccugcugcgcuucgucaaccccgacaccggccgcgugcuguucgagugcaagcugcacaagagcggguacgugaccgucgcccacaccggccagcacgaccuggugaucccgcccaacggguacuuccgguucgacuccugggugaaccaguucuacacccucgcccccaugggcaacggcgcggggcgccggcgcuga

SEQ ID NO: 11913 - RNA, 1617 nt, Artificial Sequence
  derived and/or modified sequence opt1 from VP1__Norovirus_and/or_Norovirus-like__AB447460
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacagcuacgaccccaccgaggagaucccggcgccccucggcacgcccgacuucguggggaagauccagggccugcugacccagaccaccaagggggacggcuccacgcggggccacaaggccaccgucuacaccgggagcgcccccuucaccccgaagcucggcagcgugcaguucuccacggacaccgagaacgacuucgagacccaccagaacaccaaguucacgcccgugggggucauccaggacggcagcaccacccaccgcaacgagccccagcagugggugcugcccuccuacagcgggcggaacgugcacaacguccaccuggccccggccguggcgcccaccuuccccggcgagcagcuccuguucuuccgcuccacgaugcccggcugcagcggguacccgaacauggaccuggacugccuccugccccaggagugggugcagcacuucuaccaggaggccgcccccgcccaguccgacgucgcgcugcuccgguucgugaaccccgacaccggccgcgugcuguucgagugcaagcugcacaagagcggguacgucaccguggcccacaccggccagcacgaccucgugaucccgcccaacggguacuuccgguucgacuccugggucaaccaguucuacacccuggcccccaugggcaacggcacggggcgccggcgcuga

SEQ ID NO: 11914 - RNA, 1617 nt, Artificial Sequence
  derived and/or modified sequence opt1 from VP1__Norovirus_and/or_Norovirus-like__AB447454
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcuccgugcaguucagcaccgacaccgagaacgacuucgagacccaccagaacacgaaguucacccccgucggggugauccaggacggcgggaccacccaccgcaacgagccccagcagugggugcuccccagcuacuccggccggaacguccacaacgugcaccuggccccggccguggcgcccacguuccccggcgagcagcuccucuucuuccgcagcaccaugcccgggugcuccggcuacccgaacaugaaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgccggcgcuga

SEQ ID NO: 11915 - RNA, 1617 nt, Artificial Sequence
  derived and/or modified sequence opt1 from VP1__Norovirus_and/or_Norovirus-like__AB447443
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagcucccggcgccccugggcacgcccgacuucguggggaagauccagggcguccugacccagaccaccaagggggacggcagcacgcggggccacaaggccaccguguacaccggguccgcccccuucaccccgaagcucggcagcgugcaguucagcacggacaccgagaacgacuucgagacccaccagaacaccaaguucacgcccgucggggugauccaggacggcuccaccacccaccgcaacgagccccagcagugggugcugcccagcuacuccgggcggaacguccacaacgugcaccuggccccggccguggcgcccaccuuccccggcgagcagcuccuguucuuccgcagcacgaugcccggcugcuccggguacccgaacauggaccuggacugccuccugccccaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcacggggcgccggcgcuga

SEQ ID NO: 11916 - RNA, 1617 nt, Artificial Sequence
  derived and/or modified sequence opt1 from VP1__Norovirus_and/or_Norovirus-like__AB447430
augaagauggccagcaacgacgccaaccccuccgacggcagcaccgcgaaccuggugccggaggucaacaacgaggugauggcccucgagcccguggucggggccgccaucgccgcgcccguggccggccagaccaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccaaggugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgccggcgaggacguguucaccgugagcugccgcguccugacccggcccuccccggacuucgacuucaucuuccucgugccgcccaccguggagagccgcaccaagcccuucaccguccccauccugaccguggaggagaugacgaacucccgguuccccaucccccuggagaagcuguucaccggccccagcggggcguucgugguccagccgcagaacggccgcugcaccaccgacggggugcugcugggcacgacccagcucucccccgucaacaucugcaccuuccggggcgacgugacccacaucgccgggagccgcaacuacacgaugaaccuggccucccugaacuggaacaacuacgaccccaccgaggagaucccggcgccccucggcacccccgacuucguggggaagauccagggcguccugacccagacgaccaagggggacggcagcacccggggccacaaggccaccguguacacgggguccgcccccuucaccccgaagcugggcagcgugcaguucagcaccgacaccgagaacgacuucgagacgcaccagaacaccaaguucacccccgucggggugauccaggacggcuccaccacgcaccgcaacgagccccagcagugggugcuccccagcuacuccgggcggaacguccacaacgugcaccuggccccggccguggcccccaccuuccccggcgagcagcuccucuucuuccgcagcaccaugcccggcugcuccggguacccgaacauggaccuggacugccugcucccccaggaguggguccagcacuucuaccaggaggccgcgcccgcccagagcgacguggcccugcugcgguucgugaaccccgacaccggccgcguccucuucgagugcaagcugcacaaguccggguacgugaccguggcccacacgggccagcacgaccuggucaucccgcccaacggguacuuccgguucgacagcugggugaaccaguucuacacccucgcgcccaugggcaacggcaccgggcgccggcgcuga

SEQ ID NO: 11917 - RNA, 1617 nt, Artificial Sequence
  derived and/or modified sequence opt1 from VP1__Norovirus_and/or_Norovirus-like__EU078420
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuuccaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 11918 - RNA, 1617 nt, Artificial Sequence
  derived and/or modified sequence opt1 from VP1__Norovirus_and/or_Norovirus-like__AB385637
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccaacuacuccgggcgggacggccacaacgugcaccucgccccggccguggcccccagcuuccccggggagcagcugcuguucuuccgcuccacgaugcccggcugcagcggcuacccgaacaugaaccucgacugccugcugccccaggaguggguccagcacuucuaccaggaggccgcgcccgcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgguga

SEQ ID NO: 11919 - RNA, 1617 nt, Artificial Sequence
  derived and/or modified sequence opt1 from VP1__Norovirus_and/or_Norovirus-like__EF202568
augaagauggccagcaacgacgccacccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccagcuucgugguccagccccagaacgggcgcugcacgaccgacggcgugcuccuggggaccacccagcucucccccgucaacaucugcacguuccggggcgacgugacccacaucgccggcacccagaacuacaccaugaaccuggccagccagaacuggaacaacuacgacccgacggaggagauccccgcgccccuggggacccccgacuucgugggcaagauccaggggguccucacccagaccacgcgccgggacggcuccacccgcgggcacaaggccaccgugagcaccggcagcgugcacuucacgccgaagcugggcuccguccaguucagcaccgacaccuccaacgacuucgagaccgggcagaacacgcgguucacccccgugggcgugguccaggacgggagcaccacgccccagaacgagccccagcagugggugcugccggacuacuccggccgcgacagccacaacgugcaccucgcccccgccgucgcccccaccuuccccggggagcagcugcuguucuuccgguccaccaugccgggcugcagcggcuaccccaacaugaaccucgacugccugcugccccaggagugggugcagcacuucuaccaggaguccgcccccgcgcagagcgacguggcccuccugcgcuucgucaacccggacaccgggcgggugcuguucgagugcaagcuccacaaguccggcuacgugaccgucgcccacaccgggcagcacgaccuggugaucccgcccaacggcuacuuccgcuucgacagcugggugaaccaguucuacacgcuggcccccauggggaacggcgcgggccggcgccgcuga

SEQ ID NO: 11920 - RNA, 1617 nt, Artificial Sequence
  derived and/or modified sequence opt1 from VP1__Norovirus_and/or_Norovirus-like__AB294781
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccgugcugaccguggaggagaugaccaacagccgguuccccaucccccuggagaagcuguucacgggcccguccggggccuucgucgugcagccccagaacggccgcugcaccaccgacgggguccuccugggcaccacgcagcucagccccgugaacaucugcaccuuccggggcgacgugacccacaucgccgggacccacaacuacacgaugaaccuggccucccagaacuggaacaacuacgacccgaccgaggagauccccgcgccccugggcacccccgacuucgucgggcgcauccagggcaugcucacccagacgaccaagggggacggcagcacccggggccacaaggccaccguguccacgggggacgugcacuucaccccgaagcugggcagcauccaguucaacaccgacaccaacaacgacuucgagacggggcagaacaccaaguucacccccgucggcguggugcaggacgggaacggcacccaccagaacgagccccagcaguggguccugcccuccuacagcggccgcacggggcacaacgugcaccucgccccggccguggcccccaccuuccccggcgagcagcugcuguucuuccggagcaccaugcccgggugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacacgggccagcacgaccuggucaucccgcccaacggguacuuccgcuucgacagcugggugaaccaguucuacacccuggcgcccaugggcaacgggaccggccggcgccgguga

SEQ ID NO: 11921 - RNA, 1617 nt, Artificial Sequence
  derived and/or modified sequence opt1 from VP1__Norovirus_and/or_Norovirus-like__AB303940
augaagauggccagcaacgacgccacccccuccgacggcagcaccgcgaaccuggugccggaggucaacacggaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugacgauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcggaccaacaacgccggcgacgacguguucaccguguccugccgcguccugacccggccgagccccgacuucgacuucaucuuccucgugccgcccaccguggagucccgcaccaagcccuucagcguccccauccugacgguggaggagaugaccaacucccgguuccccaucccccuggagaagcuguucaccggcccgagcuccgcguucgugguccagccccagaacgggcgcugcaccacggacggcgugcuccuggggaccacccagcucagccccgucaacaucugcaccuuccggggcgacgugacgcacaucgccggcacccagaacuacaccaugaaccuggccucccagaacuggaacaacuacgacccgaccgaggagauccccgcgccccuggggacgcccgacuucgugggcaagauccaggggguccucacccagaccacccgccgggacggcagcacgcgcgggcacaaggccaccguguccaccggcagcauccacuucaccccgaagcugggcagcgugcaguucuccacggacaccagcaacgacuucgagaccgggcagaacacccgguucacgcccgucggcguggugcaggacggguccaccacccaccagaacgagccccagcaguggguccugcccgacuacagcggccgcgacucccacaacgugcaccucgccccggccguggcccccaccuuccccggggagcagcugcuguucuuccggagcaccaugcccggcugcuccggcuacccgaacaugaaccucgacugccugcugccccaggaguggguccagcacuucuaccaggagagcgcccccgcccaguccgacguggcgcuccugcgcuucgugaaccccgacacggggcggguccuguucgagugcaagcuccacaagagcggcuacgugaccguggcccacaccgggcagcacgaccuggucaucccgcccaacggcuacuuccgcuucgacuccugggugaaccaguucuacacccuggcccccauggggaacggcgccggccggcgccgcuga

SEQ ID NO: 11922 - RNA, 1617 nt, Artificial Sequence
  derived and/or modified sequence opt1 from VP1__Norovirus_and/or_Norovirus-like__DQ415279
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacgucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgaggacguguucaccgucuccugccgcgugcugacccggccgagccccgacuucgacuucaucuuccucgugccgcccaccgucgagucccgcacgaagcccuucaccgugcccauccugaccguggaggagaugaccaacagccgguuccccaucccccuggagaagcuguucacgggcccguccggggccuucgucgugcagccccagaacggccgcugcaccaccgacgggguccuccugggcaccacgcagcucagccccgugaacaucugcaccuuccggggcgacgugacccacaucgccgggacccacaacuacacgaugaaccuggccucccagaacuggaacaacuacgacccgaccgaggagauccccgcgccccugggcacccccgacuucgucgggcgcauccagggcaugcucacccagacgacccgcggggacggcagcacccggggccacaaggccaccguguccacgggggacgugcacuucaccccgaagcugggcagcauccaguucaacaccgacaccaacaacgacuucgagacggggcagaacaccaaguucacccccgucggcguggugcaggacgggaacggcacccaccagaacgagccccagcaguggguccugcccuccuacagcggccggacggggcacaacgugcaccucgccccggccguggcccccaccuuccccggcgagcagcugcuguucuuccgcagcaccaugcccgggugcuccggcuacccgaacaugaaccucgacugccugcugccccaggaguggguccagcacuucuaccaggaggccgcgcccgcccagagcgacguggcccuccugcgguucgugaaccccgacaccgggcgcguccuguucgagugcaagcuccacaaguccggcuacgugaccguggcccacacgggccagcacgaccuggucaucccgcccaacggguacuuccgguucgacagcugggugaaccaguucuacacccuggcgcccaugggcaacgggaccggccgccggcgcuga

SEQ ID NO: 11923 - RNA, 1617 nt, Artificial Sequence
  derived and/or modified sequence opt1 from VP1__Norovirus_and/or_Norovirus-like__DQ078794
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggugcugagccccucccaggucaccauguucccccacaucaucguggacgugcggcagcuggagcccguccucaucccgcugcccgacgugcgcaacaaccuguaccacuacaaccagagcaacgaccccacgauccggcucaucgccaugcuguacacgccccugcgcgccaacaacgcgggggacgacguguucaccgucuccugccgggugcucacccgcccgagccccgacuucgacuucauguuccuggugccgcccaccgucgagucccggaccaagcccuucagcgugcccauccugaccguggaggagaugaccaacucccgcuuccccaucccccucgagaagcuguucacgggcccgagcuccgccuucgucgugcagccccagaacggccggugcaccaccgacgggguccugcucggcaccacgcagcugagccccgugaacaucugcaccuuccgcggggacgugacccacaucgccggcgcccagaacuacaccaugaaccuggccucccagaacuggaacaacuacgacccgacggaggagauccccgcgccccucggcacccccgacuucgucgggaagauccagggcgugcugacccagaccacgcggcgcgacgggagcacccggggccacaaggccaccguguccaccgggagcguccacuucacgccgaagcugggcagcgugcaguucuccaccgacaccagcaacgacuucgagaccggccagaacacgcgcuucacccccgugggggucgugcaggacggcuccaccacccaccagaacgagccccagcagugggugcuccccgacuacagcgggcgggacucccacaacguccaccuggccccggccguggcccccacguuccccggcgagcagcuccucuucuuccgcagcaccaugcccgggugcuccggcuacccgaacaugaaccuggacugccugcucccccaggagugggugcagcacuucuaccaggagagcgcgcccgcccaguccgacgucgcccugcugcgguucgugaaccccgacaccggccgcgugcuguucgagugcaagcugcacaagagcggguacgucaccguggcccacaccggccagcacgaccuggugaucccgcccaacggguacuuccgguucgacuccuggaucaaccaguucuacacgcucgcgcccaugggcaacggggccggccgccgccgguga

SEQ ID NO: 11924 - RNA, 1617 nt, Artificial Sequence
  derived and/or modified sequence opt1 from VP1__Norovirus_and/or_Norovirus-like__KP784691
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcugcuggggaccacgcagcucagccccgucaacaucugcaccuuccggggcgacgugacccacaucgccggcacccacaacuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccguguccacgggcgacgcccacuucaccccgaagcuggggagcgugauguucagcaccgacaccaacaacgacuucgagacgggccagaacacccgcuucacccccgucgggguggugcaggacggcuccaccacgcaccagaacgagccccagcaguggguccugcccagcuaccucgggcgggacucccacaacgugcaccuggccccggccguggcccccagcuuccccggcgagcagcuccucuucuuccgcuccaccaugcccggcugcagcggguacccgaacaugaacauggacugccugcugccccaggaguggguccagcacuucuaccaggaggcggcccccgcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacggcaccgggcgccggcgcuga

SEQ ID NO: 11925 - RNA, 1617 nt, Artificial Sequence
  derived and/or modified sequence opt1 from VP1__Norovirus_and/or_Norovirus-like__KX907727
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgacccgaccgaggagauccccgcgccccuggggacgcccgacuucgucggcaagauccaggggaugcucacccagaccacccggacggacggcagcacccgcgggcacaaggccaucguguacaccggcagcgccgacuucgccccgaagcugggccgggugcaguucgagaccgacacggaccacgacuucgaggccaaccagaacaccaaguucacccccgucggggugauccaggacggcuccaccacgcaccgcaacgagccccagcagugggugcugcccagcuacuccgggcggaacacccacaacguccaccucgccccggcgguggcccccaccuuccccggcgagcagcugcuguucuuccgcagcaccaugcccgggugcuccggcuacccgaacauggaccucgacugccugcugccccaggagugggugcaguacuucuaccaggaggccgcccccgcgcagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggaccggccgccgccgguga

SEQ ID NO: 11926 - RNA, 1617 nt, Artificial Sequence
  derived and/or modified sequence opt1 from VP1__Norovirus_and/or_Norovirus-like__KX354049
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccgggccgacggcagcacgcgcgggcacaaggccaccguguacaccggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgcgccggccguggcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgguga

SEQ ID NO: 11927 - RNA, 1617 nt, Artificial Sequence
  derived and/or modified sequence opt1 from VP1__Norovirus_and/or_Norovirus-like__KX354024
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccgcaacuacaccaugaaccuggccucccagaacuggaacaacuacgacccgacggaggagauccccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacacccacaacguccaccucgccccggcgguggcccccacguuccccggcgagcagcugcuguucuuccgcagcaccaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 11928 - RNA, 1617 nt, Artificial Sequence
  derived and/or modified sequence opt1 from VP1__Norovirus_and/or_Norovirus-like__KX353955
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgaggcccaccagaacaccaaguucacccccgucggggugauccaggacggcagcacgacccaccgcaacgagccccagcagugggugcuccccuccuacagcgggcggaacguccacaacgugcaccuggccccggcgguggcccccaccuuccccggcgagcagcuccucuucuuccgcuccaccaugcccggcugcagcggguacccgaacauggaccuggacugccugcucccccaggaguggguccagcacuucuaccaggaggccgcccccgcgcaguccgacguggcccugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcuga

SEQ ID NO: 11929 - RNA, 1617 nt, Artificial Sequence
  derived and/or modified sequence opt1 from VP1__Norovirus_and/or_Norovirus-like__AB972518
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaccaccccgaacguccaccucgcccccgcgguggcccccacguuccccggcgagcagcugcuguucuuccgguccaccaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacgcuggcccccaugggcaacgggaccggccgccggcgcuga

SEQ ID NO: 11930 - RNA, 1617 nt, Artificial Sequence
  derived and/or modified sequence opt1 from VP1__Norovirus_and/or_Norovirus-like__AB933744
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccgcaacuacaccaugaaccuggccucccagaacuggaacagcuacgacccgacggaggagauccccgcgccccuggggacccccgacuucgugggcaagauccaggggguccucacccagaccacgcggaccgacggcagcacccgcgggcacaaggccaccguguacacgggcuccgccgacuucagcccgaagcugggccgggugcaguucgccaccgacaccgacaacgacuucgacgccaaccagaacaccaaguucacgcccgucggggugauccaggacggcgggaccgcccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgccaccgucgcccacaccgggcagcacgaccuggugaucccgcccaacggcuacuuccgguucgacuccugggugaaccaguucuacacccuggcccccauggggaacggcacgggccgccgccgguga

SEQ ID NO: 11931 - RNA, 1617 nt, Artificial Sequence
  derived and/or modified sequence opt1 from VP1__Norovirus_and/or_Norovirus-like__AB933673
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggccagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11932 - RNA, 1617 nt, Artificial Sequence
  derived and/or modified sequence opt1 from VP1__Norovirus_and/or_Norovirus-like__KM245070
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggggcgcccccuucaccccgaagcugggguccgugcaguucagcacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 11933 - RNA, 1617 nt, Artificial Sequence
  derived and/or modified sequence opt1 from VP1__Norovirus_and/or_Norovirus-like__EU921382
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagcugaacgacuccaccaucaagcucaucgccaugcuguacacgccccugcgggcgaacaacgccggcgaggacguguucaccgugagcugccgcguccucacccggcccuccccggacuucgacuucaucuuccuggugccgcccaccguggagagccgcaccaagcccuucacgguccccauccugaccguggaggagaugaccaacucccgguuccccaucccccucgagaagcuguucaccggccccagcggggccuucgugguccagccgcagaacggccgcugcacgaccgacggggugcugcucggcaccacccagcugucccccgucaacaucugcacguuccggggcgacgugacccacaucgccgggagccgcgacuacaccaugaaccuggccucccucaacuggaacaacuacgaccccaccgaggagaucccggcgccccugggcacgcccgacuucguggggaagauccagggcguccugacccagaccaccaagggggacggcagcacgcggggccacaaggccaccguguacaccggguccgcccccuucaccccgaagcucggcagcgugcaguucagcacggacaccgagaacgacuucgagacccaccagaacaccaaguucacgcccgucggggugauccaggacggcuccaccacccaccgcaacgagccccagcagugggugcugcccagcuacuccgggcggaacguccacaacgugcaccuggccccggccguggcgcccaccuuccccggcgagcagcuccuguucuuccgcagcacgaugcccggcugcuccggguacccgaacauggaccuggacugccuccugccccaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcacggggcgccggcgcuga

SEQ ID NO: 11934 - RNA, 1617 nt, Artificial Sequence
  derived and/or modified sequence opt1 from VP1__Norovirus_and/or_Norovirus-like__KP293589
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggacauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 11935 - RNA, 1617 nt, Artificial Sequence
  derived and/or modified sequence opt1 from VP1__Norovirus_and/or_Norovirus-like__KP241908
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgcuga

SEQ ID NO: 11936 - RNA, 1617 nt, Artificial Sequence
  derived and/or modified sequence opt1 from VP1__Norovirus_and/or_Norovirus-like__KJ451059
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccgccggcgcuga

SEQ ID NO: 11937 - RNA, 1617 nt, Artificial Sequence
  derived and/or modified sequence opt1 from VP1__Norovirus_and/or_Norovirus-like__KM198570
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggggcgcgccccugggcccggaccucaaccccuaccugucccaccuggcccgcauguacaacggguacgccggcggguucgaggugcaggucauccucgccggcaacgccuucaccgccgggaagaucaucuucgccgccgugccgcccaacuucccgacggagggccugagccccucccaggugaccauguucccccacaucaucgucgacgugcggcagcuggagcccgugcucaucccgcugcccgacguccgcaacaacuucuaccacuacaaccagaccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacggggcccuccggcgccuucgugguccagccgcagaacgggcgcugcaccaccgacggcgugcugcugggcaccacgcagcucagccccgucaacaucugcaccuuccgcggggacgugacccacaucgccggcucccggaacuacaccaugaaccuggccagccugaacuggaacaacuacgaccccacggaggagaucccggcgccccucgggacccccgacuucgugggcaagauccaggggguccugacccagaccacgaagggcgacggcuccacccgggggcacaaggccaccguguacaccggcagcgcccccuucacgccgaagcugggguccgugcaguucagcaccgacaccgagaacgacuucgagacccaccagaacacgaaguucacccccgucggcgugauccaggacgggggcaccacccaccgcaacgagccccagcagugggugcuccccagcuacuccggccgggacguccacaacgugcaccuggccccggccguggcgcccacguuccccggggagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaacggccagcacgaccuggucaucccgcccaacggcuacuuccgguucgacagcugggugaaccaguucuacacccucgcccccauggggaacggcacggggcgccggcgcuga

SEQ ID NO: 11938 - RNA, 1617 nt, Artificial Sequence
  derived and/or modified sequence opt1 from VP1__Norovirus_and/or_Norovirus-like__KM198558
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggucccgcgacuacaccaugaaccuggccagccugaacuggaacaacuacgacccgacggaggagauccccgcgccccucggcacccccgacuucguggggaagauccagggcguccugacccagaccacgcgcggggacggcuccacccggggccacaaggccaccguguacaccgggagcgccccguucgcccccaagcugggcuccgugcaguucagcacggacaccgagaacgacuucgagacccaccagaacaccaaguucacgcccgucggggugauccaggacggcgggaccacccaccggaacgagccccagcagugggugcucccgagcuacuccggccgcgacguccacaacgugcaccuggcccccgcgguggcccccaccuuccccggcgagcagcuccucuucuuccggagcacgaugccggggugcuccggcuaccccaacauggaccuggacugccugcucccccaggaguggguccagcacuucuaccaggaggccgcccccgcgcagagcgacguggcccugcugcgcuucgugaacccggacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccaugggcaacgggacgggccggcgccgcuga

SEQ ID NO: 11939 - RNA, 1617 nt, Artificial Sequence
  derived and/or modified sequence opt1 from VP1__Norovirus_and/or_Norovirus-like__AB447456
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggccugcugacccagaccaccaagggggacggcagcacgcggggccacaaggccaccgucuacaccggguccgcccccuucaccccgaagcucggcagcgugcaguucagcacggacaccgagaacgacuucgagacccaccagaacaccaaguucacgcccgugggggucauccaggacggcuccaccacccaccgcaacgagccccagcagugggugcugcccagcuacuccgggcggaacgugcacaacguccaccuggccccggccguggcgcccaccuuccccggcgagcagcuccuguucuuccgcagcacgaugcccggcugcuccggguacccgaacauggaccuggacugccuccugccccaggagugggugcagcacuucuaccaggaggccgcccccgcccagagcgacgucgcgcugcuccgguucgugaaccccgacaccggccgcgugcuguucgagugcaagcugcacaaguccggguacgucaccguggcccacaccggccagcacgaccucgugaucccgcccaacggguacuuccgguucgacagcugggucaaccaguucuacacccuggcccccaugggcaacggcacggggcgccggcgcuga

SEQ ID NO: 11940 - RNA, 1617 nt, Artificial Sequence
  derived and/or modified sequence opt1 from VP1__Norovirus_and/or_Norovirus-like__KF177444
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugaucgacgugcggcagcuggagcccguccucaucccgcugcccgacgugcgcaacaacuucuaccacuacaaccagagcaacgaccccaccaucaagcugaucgccaugcucuacacgccccugcgggcgaacaacgccggcgacgacguguucaccgucuccugccgcgugcugacccggccgagccccgacuucgacuucaucuuccucgugccgcccaccgucgagucccgcaccaagcccuucagcgugcccgugcugacggucgaggagaugaccaacucccgguuccccaucccccuggagaagcuguucaccggcccgagcuccgccuucgugguccagccccagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 11941 - RNA, 1617 nt, Artificial Sequence
  derived and/or modified sequence opt1 from VP1__Norovirus_and/or_Norovirus-like__KF429776
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucgccggcagccgcaacuacaccaugaaccuggccucccagaacuggaacagcuacgaccccaccgaggagaucccggcgccccuggggacgcccgacuucgugggcaagauccaggggguccucacccagaccacccggacggacggcagcacccgcgggcacaaggccaccguguacaccggcuccgccgacuucagccccaagcugggccgggugcaguucgccacggacaccgacaacgacuucgacgccaaccagaacaccaaguucaccccggucggggugauccaggacggcgggacggcccaccgcaacgagccccagcagugggugcugcccuccuacagcggccggaacacccacaacguccaccucgcgcccgccguggccccgaccuuccccggggagcagcugcuguucuuccgcuccaccaugcccggcugcagcggcuaccccaacauggaccucgacugccugcugccgcaggagugggugcaguacuucuaccaggaggccgcgcccgcccaguccgacgucgcccuccugcgguucgugaaccccgacacggggcgcgugcuguucgagugcaagcuccacaagcccggcuacgucaccguggcccacaccgggcagcacgaccuggugaucccgcccaacggcuacuuccgguucgacagcugggucaaccaguucuacacccuggcccccauggggaacggcaccggccgccgccgguga

SEQ ID NO: 11942 - RNA, 1617 nt, Artificial Sequence
  derived and/or modified sequence opt1 from VP1__Norovirus_and/or_Norovirus-like__KC243078
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgaggucgcccuccugcgguucgugaaccccgacaccgggcgcgugcuguucgagugcaagcuccacaagagcggcuacgucaccguggcccacaccgggcaguacgaccuggugaucccgcccaacggcuacuuccgguucgacuccugggucaaccaguucuacacccuggcccccauggggaacggcacgggccgccgccgguga

SEQ ID NO: 11943 - RNA, 1617 nt, Artificial Sequence
  derived and/or modified sequence opt1 from VP1__Norovirus_and/or_Norovirus-like__KC409280
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcuccugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaaggaggacgggagcacccggggccacaaggccaccguguacaccggcuccgcccccuucacgccgaagcuggggagcgugcaguucagcaccgacaccgagaacgacuucgagacccaccagaacacgaaguucacccccgucggcgugauccaggacgggggcaccacccaccgcaacgagccccagcagugggugcuccccuccuacagcgggcgggacguccacaacgugcaccuggccccggccguggcgcccacguuccccggcgagcagauccuguucuuccgcuccaccaugcccggcugcagcggguacccgaacauggaccucgacugccugcugccccaggaguggguccagcacuucuaccaggaggccgcccccgcccaguccgacguggcgcuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacgcuggcccccaugggcaacggcaccgggcgccggcgcuga

SEQ ID NO: 11944 - RNA, 1617 nt, Artificial Sequence
  derived and/or modified sequence opt1 from VP1__Norovirus_and/or_Norovirus-like__KC175357
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11945 - RNA, 1617 nt, Artificial Sequence
  derived and/or modified sequence opt1 from VP1__Norovirus_and/or_Norovirus-like__JX459621
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagcgccucuucaccggcccguccagcgccuucgugguccagccccagaacgggcggugcacgaccgacggcgugcugcuggggaccacccagcucucccccgucaacaucugcacguuccgcggcgacguggcccacaucgccggcacccaggaguacaccaugaaccuggccagccagaacuggaacaacuacgacccgaccgaggagauccccgcgccccuggggacgcccgacuucgugggcaagauccaggggguccucacccagaccacccggcgcgacggcuccacgcgggggcacaaggccaccgugagcaccggcagcgugcacuucaccccgaagcugggccgcauccaguucuccacggacaccagcaacgacuucgagaccgggcagaacacccgguucacgcccgucggcguggugcaggacgggggcaccacccaccagaacgagccccagcaguggguccugcccgacuacuccgggcgcgacagccacaacgugcaccucgccccggccguggcccccuccuuccccggcgagcagcugcuguucuuccggagcaccaugcccggcugcuccggguacccgaacaugaaccucgacugccugcugccccaggaguggguccagcacuucuaccaggaggcggcccccgcccagagcgacguggcccuccugcgcuucgugaaccccgacacgggccggguccuguucgagugcaagcuccacaaguccggguacgugaccguggcgcacaccggccagcacgaccuggucaucccgcccaacggguacuuccgcuucgacagcugggugaaccaguucuacacccuggcccccaugggcaacggcaccgggcgccggcgcuga

SEQ ID NO: 11946 - RNA, 1617 nt, Artificial Sequence
  derived and/or modified sequence opt1 from VP1__Norovirus_and/or_Norovirus-like__JQ613541
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccguggucccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggccaacaacgccggcgacgacgucuucaccgugagcugccgcgugcugacccggccgucccccgacuucgacuucaucuuccucgucccgcccaccguggagagccgcacgaagcccuucuccgugcccauccugaccgucgaggagaugaccaacagccgguuccccaucccccuggagaagcuguucaccggcccguccagcgcguucgugguccagccccagaacgggcgcugcacgaccgacggcgugcuccuggggaccacccagcucucccccgugaacaucugcacguuccggggcgacgucacccacaucgccggcagccacaacuacaccaugaaccuggccucccagaacuggaacagcuacgacccgaccgaggagauccccgcgccccuggggacgcccgacuucgugggcaagauccagggggugcucacccagaccacccgcacggacggcagcacccgggggcacaaggccaccgucuacaccggcuccgccgaguucagcccgaagcugggccgcgugcaguucgccacggacaccaacaacgacuucgacgccaaccagaacaccaaguucacccccgugggggucauccaggacggcgggacgacccaccggaacgagccccagcagugggugcugcccuccuacagcggccgcaacacccacaacgugcaccucgccccggccgucgcgcccaccuuccccggggagcagcugcuguucuuccgguccacgaugcccggcugcagcggcuacccgaacauggaccucgacugccugcugccccaggagugggugcaguacuucuaccaggaggccgcccccgcccaguccgacguggcgcuccugcgcuucgucaaccccgacaccgggcgggugcuguucgagugcaagcuccacaagagcggcuacgugaccgucgcccacaucgggcagcacgaccuggugaucccgcccaacggcuacuuccgcuucgacuccugggugaaccaguucuacacccuggcccccauggggaacggcaccggccggcgccgcuga

SEQ ID NO: 11947 - RNA, 1617 nt, Artificial Sequence
  derived and/or modified sequence opt1 from VP1__Norovirus_and/or_Norovirus-like__JQ613527
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggguccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucgccggcagccacaacuacaccaugaaccuggccucccagaacuggaacagcuacgacccgaccgaggagauccccgcgccccuggggacgcccgacuucgucggcaagauccagggggugcucacccagaccacccgcacggacggcagcacccgggggcacaaggccaccguguacaccggcuccacggaguucagcccgaagcugggccgcguccaguucgccaccgacaccaacaacgacuucgacgccaaccagaacaccaaguucacgcccgugggggugauccaggacggcgggaccacccaccggaacgagccccagcaguggguccugcccuccuacagcggccgcaacacccacaacgugcaccucgccccggccguggcgcccacguuccccggggagcagcugcuguucuuccgguccaccaugcccggcugcagcggcuacccgaacauggaccucgacugccugcugccccaggaguggguccaguacuucuaccaggaggccgcccccgcccaguccgacguggcgcuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacgcuggcccccauggggaacggcaccggccggcgccgcuga

SEQ ID NO: 11948 - RNA, 1617 nt, Artificial Sequence
  derived and/or modified sequence opt1 from VP1__Norovirus_and/or_Norovirus-like__JF827296
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacguguucaccgccggcaagaucaucuucgcggccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccacgaucaagcugaucgccaugcucuacacgccccugcgggccaacaacgccggcgacgacguguucaccgucuccugccgcgugcugacccggccgagccccgacuucgacuucaucuuccucgcgccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcauccaguucuccaccgacaccagcaacgacuucgagacggggcagaacacccgguucacccccgucggcguggugcaggacggguccaccacgcaccagaacgagccccagcaguggguccugcccgacuacagcggccgcgacucccacaacgugcaccucgccccggccguggcccccaccuuccccggggagcagcugcuguucuuccggagcaccaugcccggcugcuccggcuacccgaacaugaaccucgacugccugcugccccaggaguggguccagcacuucuaccaggagagcgcccccgcgcaguccgacguggcccuccugcgcuucgugaaccccgacaccgggcggguccuguucgagugcaagcuccacaagagcggcuacgugaccguggcccacacggggcagcacgaccuggucaucccgcccaacggcuacuuccgcuucgacuccugggugaaccaguucuacacccuggcccccauggggaacggcgcgggccggcgccgcuga

SEQ ID NO: 11949 - RNA, 1617 nt, Artificial Sequence
  derived and/or modified sequence opt1 from VP1__Norovirus_and/or_Norovirus-like__JF713050
augaagauggccagcaacgacgccaaccccuccgacggcagcgcggccaaccuggugcccgaggucaacaacgaggugauggcccucgagcccguggccggggccgcgcuggccgcccccgucgccggccagcagaacgugaucgaccccuggauccgcaacaacuucgugcaggcgcccgggggcgaguucaccgucagcccccggaacgcccccggggagauccugugguccgcgccccucuccccggaccugaaccccuaccugagccaccucgcccgcauguacaacuccuacgccggcggcuucgagguccaggugauccuggccgggaacgccuucaccgccggcaagaucaucuucgccgccgugccgcccaacuucccgaucgaggggcugagccccucccaggugacgauguucccccacaucaucguggacguccggcagcucgagcccgugcugaucccgcugcccgacgugcgcaacaacuucuaccacuacaaccagagcaacgagcccaccaucaagcucaucgcgaugcuguacacgccccugcgggccaacaacgccggcgaggacgucuucaccguguccugccgcgugcucacccggccgagccccgacuucgacuucaucuuccuggucccgcccaccguggagucccgcaccaagcccuucaccgugcccauccugacggucgaggagaugaccaacagccgguuccccaucccccucgagaagcuguucaccgggccguccagcuccuucguggugcagccccagaacggccgcugcaccacggacggcguccugcucgggaccacccagcugagccccgugaacaucugcaccuuccggggcgacgucacgcacaucgccgggucccgcaacuacaccaugaaccuggccagcaucaacuggaacaacuacgacccgaccgaggagauccccgcgccccucggcacccccgacuucgugggcaagauccaggggaugcugacgcagaccacccggggcgacgggagcacccgcggccaccgggccacgguguacaccggguccgccccguucacccccaagcugggcagcguccaguucaccacggacaccgacaacgacuucgagaccaaccagaacaccaaguucacgcccgugggcgugguccaggacggggacaccgcccaccgcaacgagccccagcagugggugcucccguccuacagcggccggaacgugcagaacguccaccuggcccccgcgguggcccccaccuuccccggggagcagcuccuguucuuccgcuccaccaugccgggcugcagcggguaccccaacauggaccuggacugccugcucccccaggagugggugcagcacuucuaccaggaggccgcccccgcgcaguccgacgucgcccugcugcgguucgugaacccggacacgggccgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcaccgggcgccgccgguga

SEQ ID NO: 11950 - RNA, 1617 nt, Artificial Sequence
  derived and/or modified sequence opt1 from VP1__Norovirus_and/or_Norovirus-like__HM802548
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcagcuaccggaugaaccuggccucccagaacuggaacaacuacgacccgacggaggagauccccgcgccccuggggacccccgacuucgugggcaagauccaggggaugcucacccagaccacgaagcgcgacggcagcacccgggggcacaaggccaccgucagcaccggcuccguggacuucacgccgaagcugggcagcgugcaguucgccaccgacaccgacaacgacuucgagaccgggcagaacacgcgcuucacccccgucggcgugauccaggacggguccagcacccaccggaacgagccccagcagugggugcugcccgacuacuccggccgcaccguccacaacgugcaccucgccccggccguggcccccacguuccccggggagcagcugcuguucuuccggagcaccaugcccggcugcuccggcuacccgaacauggaccucgacugccugcugccccaggaguggguccagcacuucuaccaggaggccgcgcccagccaguccgacguggcccuccugcgcuucgugaaccccgacaccgggcggguccuguucgagugcaagcuccacaaggccggcuacgugaccguggcccacaccgggcagcacgaccuggucaucccgcccaacggcuacuuccgcuucgacagcugggugaaccaguucuacacgcuggcgcccauggggaacggcgccggccgccggcgcuga

SEQ ID NO: 11951 - RNA, 1617 nt, Artificial Sequence
  derived and/or modified sequence opt1 from VP1__Norovirus_and/or_Norovirus-like__GQ856459
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcagaugauccucgccgggaacgccuucaccgccggcaagaucaucuucgccgccgucccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccugcuggggaccacccagcucagccccgugaacaucugcacguuccggggcgacgucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcggaacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgggcuggugaucccgcccaacggcuacuuccgguucgacagcugggucaaccaguucuacacccucgcccccaugggcaacgggacgggccgccggcgcuga

SEQ ID NO: 11952 - RNA, 1617 nt, Artificial Sequence
  derived and/or modified sequence opt1 from VP1__Norovirus_and/or_Norovirus-like__AB541308
augaagauggccagcaacgacgccaaccccuccgacggcagcgcggccaaccuggugcccgaggucaacaacgaggugauggcccucgaccccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucugccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11953 - RNA, 1617 nt, Artificial Sequence
  derived and/or modified sequence opt1 from VP1__Norovirus_and/or_Norovirus-like__AB541276
augaagauggccagcaacgacgccaaccccuccgacggcagcgcggccucccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggagcgcccccuucaccccgaagcugggcuccgugcaguucagcacggacaccgagaacgacuucgagacccaccagaacaccaaguucacgcccgucggggugauccaggacggcuccaccacccaccgcaacgagccccagcagugggugcuccccagcuacuccgggcgggacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11954 - RNA, 1617 nt, Artificial Sequence
  derived and/or modified sequence opt1 from VP1__Norovirus_and/or_Norovirus-like__AB541224
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11955 - RNA, 1617 nt, Artificial Sequence
  derived and/or modified sequence opt1 from VP1__Norovirus_and/or_Norovirus-like__AB504330
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccugaucccccucgagaagcuguucacgggccccagcggggccuucgugguccagccccagaacggccgcugcaccaccgacggggugcugcucggcaccacgcagcuguccccggucaacaucugcaccuuccggggcgacgugacccacaucgccgggagccgcaacuacaccaugaaccuggccucccucaacuggaacaacuacgaccccacggaggagauccccgcgccgcugggcacccccgacuucguggggaagauccagggcguccugacccagaccacgaagggggacggcagcacccggggccacaaggccaccguguacaccggguccgcccccuucacgcccaagcucggcagcgugcaguucagcaccgacaccgagaacgacuucgagacccaccagaacacgaaguucaccccggucggggugauccaggacggcuccaccacccaccgcaacgagccccagcagugggugcugcccagcuacuccgggcggaacguccacaacgugcaccuggcccccgccguggcgccgacguuccccggcgagcagcuccuguucuuccgcagcaccaugcccggcugcuccggguaccccaacauggaccuggacugccuccugccgcaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacgcuggcccccaugggcaacggcaccgggcgccggcgcuga

SEQ ID NO: 11956 - RNA, 1617 nt, Artificial Sequence
  derived and/or modified sequence opt1 from VP1__Norovirus_and/or_Norovirus-like__AB447445
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggacgggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 11957 - RNA, 1617 nt, Artificial Sequence
  derived and/or modified sequence opt1 from VP1__Norovirus_and/or_Norovirus-like__AB294793
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcaugcugacccagaccaccaagggggacggcagcacgcggggccacaaggccaccgucuacaccggguccgcccccuucaccccgaagcugggcagcgugcaguucagcacggacaccgagaacgacuucgagacccaccagaacaccaaguucacgcccgugggggucauccaggacggcuccaccacccaccgcaacgagccccagcagugggugcuccccagcuacuccgggcggaacgugcacaacguccaccuggccccggccguggcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 11958 - RNA, 1617 nt, Artificial Sequence
  derived and/or modified sequence opt1 from VP1__Norovirus_and/or_Norovirus-like__AB303934
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucauccaggacgggaacggcgcccaccagaacgagccccagcagugggugcugcccuccuacagcggccggaccgggcacaacgugcaccucgccccggccgucgcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacguggcccuccugcgguucgucaaccccgacaccgggcgcgugcuguucgagugcaagcuccacaaguccggcuacaucaccguggcgcacaccggccagcacgaccuggucaucccgcccaacggguacuuccgguucgacagcugggugaaccaguucuacacgcuggcccccaugggcaacgggaccggccgccggcgcuga

SEQ ID NO: 11959 - RNA, 1617 nt, Artificial Sequence
  derived and/or modified sequence opt1 from VP1__Norovirus_and/or_Norovirus-like__KU678205
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagguccagggggugcucacccagaccacccgcacggacggcagcacccgggggcacaaggccaccguguacaccggcuccgccgacuucgccccgaagcugggccgcguccaguucgagacggacaccaaccacgacuucgaggccaaccagaacaccaaguucacccccgugggggugauccaggacggcgggacgacccaccggaacgagccccagcaguggguccugcccagcuacuccggccgcaacaccccgaacgugcaccucgcccccgcgguggcccccaccuuccccggggagcagcugcuguucuuccggagcacgaugccgggcugcuccggcuaccccaacauggaccucgacugccugcugccccaggaguggguccaguacuucuaccaggaggccgcccccgcgcagagcgacguggcccuccugcgcuucgugaacccggacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcccccauggggaacggcacgggccggcgccgcuga

SEQ ID NO: 11960 - RNA, 1617 nt, Artificial Sequence
  derived and/or modified sequence opt1 from VP1__Norovirus_and/or_Norovirus-like__LC177657
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcagcgccgacuucgccccgaagcugggccgggugcaguucgagacggacaccgaccgcgacuucgaggccaaccagaacaccaaguucacccccgugggggucauccaggacggcuccacgacccaccggaacgagccccagcagugggugcugcccagcuacuccgggcgcaacaccccgaacgugcaccucgcccccgcggucgcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacguggcccucguccgcuucgugaacccggacaccggccgggugcuguucgagugcaagcugcacaaguccggguacgucaccguggcccacaccggccagcacgaccucgugaucccgcccaacggguacuuccgcuucgacagcugggucaaccaguucuacacccuggcccccaugggcaacgggacgggccgccggcgcuga

SEQ ID NO: 11961 - RNA, 1617 nt, Artificial Sequence
  derived and/or modified sequence opt1 from VP1__Norovirus_and/or_Norovirus-like__LC177656
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccacaacuacaccaugaaccuggccucccagaacuggagcaacuacgacccgacggaggagauccccgcgccccuggggacccccgacuucgugggcaagauccaggggguccucacccagaccacgcgcaucgacggcagcacccgggggcacaaggccaccguguacaccggcuccgccgacuucgccccgaagcugggccgcgugcaguucgagacggacaccgaccacgacuucgaggccaaccagagcaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccggcgccgcuga

SEQ ID NO: 11962 - RNA, 1617 nt, Artificial Sequence
  derived and/or modified sequence opt1 from VP1__Norovirus_and/or_Norovirus-like__KX354136
augaagauggccagcuccgacgccaaccccagcgacggcuccgcggccaaccuggugccggaggucagcaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccauccugacggucgaggagaugaccaacucccgguuccccaucccccuggagaagcuguucaccggcccgagcuccgccuucguggugcagccccagaacgggcgcugcaccacggacggcguccuccuggggaccacccagcucagccccgugaacaucugcaccuuccggggcgacgucacgcacaucaccggcucccacaacuacaccaugaaccuggccagccagaacuggaacaacuacgacccgaccgaggagauccccgcgccccuggggacgcccgacuucgugggcaagauccagggggugcucacccagaccacccgcagcgacggcuccacgcgggggcacaaggccaccgucuacaccggcagcgccgacuucgccccgaagcugggccgcgugcaguucgagaccgacacggaccgggacuucgagaccaaccagaacaccaaguucacccccgugggggucauccaggacggcacgaccgcccaccgcaacgagccccagcagugggugcugcccuccuacagcgggcggaacauccacaacgugcaccucgccccggcggucgcccccaccuuccccggcgagcagcugcuguucuuccgcuccaccaugcccgggugcagcggcuacccgaacauggaccucgacugccugcugccccaggagugggugcaguacuucuaccaggaggccgcccccgcgcaguccgacguggcccuccugcgguucgucaaccccgacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgguga

SEQ ID NO: 11963 - RNA, 1617 nt, Artificial Sequence
  derived and/or modified sequence opt1 from VP1__Norovirus_and/or_Norovirus-like__KX354121
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagcgccucuucaccggcccguccagcgccuucgucgugcagccccagaacgggcggugcaccacggacggcgugcugcuggggaccacccagcucucccccgucaacaucugcaccuuccgcggcgacaucacgcacaucaccggcagccacaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgaguucgccccgaagcugggccgggugcaguucgagacggacaccaaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 11964 - RNA, 1617 nt, Artificial Sequence
  derived and/or modified sequence opt1 from VP1__Norovirus_and/or_Norovirus-like__KX354110
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagcgccucuucaccggcccguccagcgccuucgucgugcagccccagaacgggcggugcaccacggacggcgugcugcuggggaccacccagcucucccccgucaacaucugcaccuuccgcggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccaccagcacggacggcagcacccgggggcacaaggccaccguguacaccggcuccgccgaguucgccccgaagcugggccgcgugcaguucgagacggacaccgaccacgacuucgagaccaaccagaacaccaaguucacgcccgucggggugauccaggacggcagcaccacccaccggaacgagccccagcagugggugcugcccuccuacagcgggcgcaacacccacaacguccaccucgccccggccguggcgcccacguuccccggcgagcagcugcuguucuuccgguccaccaugcccgggugcagcggcuacccgaacauggaccucgacugccugcugccccaggagugggugcaguacuucuaccaggaggccgcccccgcccaguccgacgucgcgcuccugcgcuucgugaaccccgacaccggccgggugcuguucgagugcaagcuccacaagagcggguacaucaccgucgcccacaccggccagcacgaccuggugaucccgcccaacggguacuuccgcuucgacuccugggugaaccaguucuacacgcuggcccccaugggcaacgggaccggccggcgccgcuga

SEQ ID NO: 11965 - RNA, 1617 nt, Artificial Sequence
  derived and/or modified sequence opt1 from VP1__Norovirus_and/or_Norovirus-like__KX354107
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 11966 - RNA, 1617 nt, Artificial Sequence
  derived and/or modified sequence opt1 from VP1__Norovirus_and/or_Norovirus-like__KX353991
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccggauccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucgccggcucccgcaacuacaccaugaaccuggccagccagaacuggaacuccuacgacccgaccgaggagauccccgcgccccuggggacgcccgacuucgucggcaagauccagggggugcucacccagaccacccggacggacggcagcacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacccaccgcaacgagccccagcaguggguccugcccagcuacuccggccggaacacccacaacgugcaccucgccccggccguggcgcccacguuccccggggagcagcugcuguucuuccgcagcaccaugcccggcugcuccggcuacccgaacauggaccucgacugccugcugccccaggaguggguccaguacuucuaccaggaggccgcccccgcccagagcgacguggcgcuccugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacgcuggcccccauggggaacggcaccggccgccgccgguga

SEQ ID NO: 11967 - RNA, 1617 nt, Artificial Sequence
  derived and/or modified sequence opt1 from VP1__Norovirus_and/or_Norovirus-like__KU985162
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccaaccacgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccggcgccgcuga

SEQ ID NO: 11968 - RNA, 1617 nt, Artificial Sequence
  derived and/or modified sequence opt1 from VP1__Norovirus_and/or_Norovirus-like__AB972476
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgccguggcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 11969 - RNA, 1617 nt, Artificial Sequence
  derived and/or modified sequence opt1 from VP1__Norovirus_and/or_Norovirus-like__KU311162
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaaggacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccaacgccuucgugguccagccgcagaacgggcgcugcacgaccgacggcgugcuccuggggaccacccagcucagccccgucaacaucugcacguuccggggcgacgugacccagaucgccuccacccagaccuacacgaugaaccuggccagccugaacuggaacaacuacgaccccaccgaggagaucccggcgccccucggcgcccccgacuucauggggaagauccagggcgugcugacccagaccacgcgccagggcggguccacccgggggcacaaggccaccgucagcaccggcagcgugcacuucacgcccaagcugggcuccgugcgcuucgacaccgacaccaacaacgaccuccagccgcaccagagcacccgguucacgcccgucggggugauccaggacggcgacacccaccagaacgagccccagcagugggcccugcccugcuacuccgggcgcgacgugaacaacguccaccuggccccggcgguggcccccagcuuccccggcgagcagcuccuguucuuccgguccaccaugcccgggugcagcggcuacccgaacauggaccuggacugccuccugccccaggagugggugcagcacuucuaccaggaggccgcccccgcgcaguccgacgucgcccugcuccgcuucgugaaccccgacaccggccgggugcuguucgagugcaagcugcacaagagcggguacgucacgguggcccacaccggccagcacaaccucgugaucccgcccaacggguacuuccgcuucgacuccugggucaaccaguucuacacccuggcccccaugggcaacgggaccggccggcgccgcguguga

SEQ ID NO: 11970 - RNA, 1617 nt, Artificial Sequence
  derived and/or modified sequence opt1 from VP1__Norovirus_and/or_Norovirus-like__KR904212
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaccuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcaccuucgugguccagccccagaacgggcgcugcaccaccgacggcgugcuccuggggacgacccagcucucccccgucaacaucugcaccuuccggggcgacgugacccacaucacgggcagccacaacuacaccaugaaccuggccucccagaacuggagcagcuacgacccgaccgaggagauccccgcgccccuggggacccccgacuucgugggcaagauccaggggguccucacgcagaccacccgcaccgacggcuccacgcgggggcacaaggccaccguguucaccggcagcgccgacuucuccccgaagcugggccgcgugcaguucgccaccgacacggacaacgacuucgucgccaaccagaacaccaaguucacccccgugggggugauccaggacggcgggaccgcccaccggaacgagccccagcaguggguccugcccagcuacuccggccgcaacauccacaacgugcaccucgccccggccguggcgcccacguuccccggggagcagcugcuguucuuccggagcaccaugcccggcugcuccggcuacccgaacauggaccucgacugccugcugccccaggaguggguccaguacuucuaccaggaggccgcccccgcccagagcgacguggcgcuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacgcuggcccccauggggaacggcaccggccggcgccgcuga

SEQ ID NO: 11971 - RNA, 1617 nt, Artificial Sequence
  derived and/or modified sequence opt1 from VP1__Norovirus_and/or_Norovirus-like__AB933678
augaagauggccagcaacgacgccaaccccuucgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccggccgaggggcugucccccagccaggugacgauguucccccacaucaucgucgacgugcggcagcuggagcccgugcucaucccgcugcccgacguccgcaacaacuucuaccacuacaaccaguccaacgacagcaccaucaagcugaucgcgaugcucuacacgccccugcgggccaacaacgccggcgaggacguguucaccguguccugccgcguccugacccggcccagcccggacuucgacuucaucuuccucgugccgcccaccguggagucccgcaccaagcccuucaccguccccauccugacgguggaggagaugaccaacagccgguuccccaucccccuggagaagcuguucaccggccccuccagcgccuucgugguccagccgcagaacgggcgcugcaccacggacggcgugcugcuggggaccacccagcucucccccgucaacaucugcaccuuccggggcgacgugacgcacaucgccggcagccgcaacuacaccaugaaccuggcgucccugaacuggaacaacuacgaccccaccgaggagaucccggcgccccucgggacccccgacuucgugggcaagauccaggggguccugacgcagaccaccaagggcgacgggagcacccggggccacaaggccacgguguacaccggcuccgcccccuucaccccgaagcuggggagcgugcaguucagcaccgacacggagaacgacuucgagacccaccagaacaccaaguucacccccgucggcgugauccaggacgggggcacgacccaccgcaacgagccccagcagugggugcuccccuccuacagcgggcggaacgucccgaacgugcaccuggcccccgccguggcccccaccuuccccggcgagcagcuccucuucuuccgcuccaccaugccgggcugcagcggguaccccaacauggaccuggacugccugcucccccaggaguggguccagcacuucuaccaggaggccgcccccgcgcaguccgacguggcccugcugcgguucgugaacccggacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcuga

SEQ ID NO: 11972 - RNA, 1617 nt, Artificial Sequence
  derived and/or modified sequence opt1 from VP1__Norovirus_and/or_Norovirus-like__AB933648
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcgggacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11973 - RNA, 1617 nt, Artificial Sequence
  derived and/or modified sequence opt1 from VP1__Norovirus_and/or_Norovirus-like__LN854571
augaagauggccagcaacgacgccgcgcccuccgacggcagcaccgccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugauccacaucccgggcucccgcaacuacaccaugaaccuggccagccagaacuggaacuccuacgaccccaccgaggagauccccgcgccccuggggaccccggacuucgucggcaagauccagggggugcucacgcagaccacccggaccaacggcagcacgcgcgggcacaaggccaccguguacaccggcagcgccgacuucucccccaagcugggccggguccaguucgccaccgacacggacaacgacuucgagaccaaccagaacaccaaguucacccccgugggggugauccaggacggcagcacgacgccccgcaacgagccgcagcaguggguccugcccuccuacagcgggcggaacauccacaacgugcaccucgcccccgccguggcgcccaccuucccgggcgagcagcugcuguucuuccgcuccaccaugcccgggugcagcggcuaccccaacauggaccucgacugccugcugccccaggaguggguccaguacuucuaccaggaggccgccccggcccaguccgacguggcgcuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggaccggccgccgccgguga

SEQ ID NO: 11974 - RNA, 1617 nt, Artificial Sequence
  derived and/or modified sequence opt1 from VP1__Norovirus_and/or_Norovirus-like__EU921384
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 11975 - RNA, 1617 nt, Artificial Sequence
  derived and/or modified sequence opt1 from VP1__Norovirus_and/or_Norovirus-like__LC005716
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcuccuggggaccacccagcucucccccgucaacaucugcacguuccggggcgacgugacccacaucgccggcagcgggaacuacaccaugaaccuggccuccgugaacuggaacaacuacgaccccaccgaggagaucccggcgccccugggcacgcccgacuucgucgggaagauccagggcaugcucacccagaccaccaagggggacggcagcacgcgcggccacaaggccaccguguacaccgggagcgcccccuucaccccgaagcugggcuccgugcaguucagcacggacaccgagaacgacuucgagacccaccagaacaccaaguucacgcccgucggggugauccaggacggcaacaccacccaccggaacgagccccagcagugggugcugcccuccuacagcgggcgcaacgucccgaacgugcaccucgcccccgccguggcgcccaccuuccccggcgagcagcugcuguucuuccgguccacgaugccgggcugcagcggguaccccaacauggaccucgacugccugcugccccaggaguggguccagcacuucuaccaggaggccgcccccgcccaguccgacguggcgcuccugcgcuucgugaacccggacaccggccggguccuguucgagugcaagcuccacaagagcggguacgugaccguggcccacaccggccagcacgaccuggucaucccgcccaacggguacuuccgcuucgacuccugggugaaccaguucuacacccuggcccccaugggcaacggcacggggcggcgccgguga

SEQ ID NO: 11976 - RNA, 1617 nt, Artificial Sequence
  derived and/or modified sequence opt1 from VP1__Norovirus_and/or_Norovirus-like__KP241914
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucagcccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacgccccgaacguccaccucgcccccgcgguggcccccaccuuccccggggagcagcugcuguucuuccgguccaccaugccgggcugcagcggcuaccccaacauggaccucgacugccugcugccccaggagugggugcaguacuucuaccaggaggccgcccccgcgcaguccgacgucgcccuccugcgcuucgugaacccggacacggggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcaccggccgccggcgcuga

SEQ ID NO: 11977 - RNA, 1617 nt, Artificial Sequence
  derived and/or modified sequence opt1 from VP1__Norovirus_and/or_Norovirus-like__KJ433968
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccccgggaccacccagcuguccccggucaacaucugcaccuuccggggcgacgugacgcacaucaccggcagccgcaacuacaccaugaaccucgccucccagaacuggaacaacuacgaccccaccgaggagauccccgcgccccuggggacgccggacuucgugggcaagauccaggggguccugacccagaccacccggagcgacggcagcacgcgcgggcacaaggccaccguguacaccggcuccgccgacuucgcccccaagcucggccgggugcaguucgagaccgacacggaccgcgacuucgaggccaaccagaacaccaaguucacccccgucggggugauccaggacggcgggaccacgcaccggaacgagccccagcagugggugcugccgagcuacuccggccgcaacacccccaacguccaccuggcccccgcgguggcccccaccuucccgggggagcagcuccuguucuuccggagcaccaugcccggcugcuccggcuaccccaacauggaccuggacugccuccugccccaggagugggugcaguacuucuaccaggaggccgccccggcgcagagcgacgucgcccugcuccgcuucgugaaccccgacacggggcgggugcuguucgagugcaagcugcacaaguccggcuacgucaccguggcccacaccgggcagcacgaccucgugaucccgcccaacggcuacuuccgcuucgacagcugggucaaccaguucuacacccuggcccccauggggaacggcaccggccgccggcgcuga

SEQ ID NO: 11978 - RNA, 1617 nt, Artificial Sequence
  derived and/or modified sequence opt1 from VP1__Norovirus_and/or_Norovirus-like__KP176409
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcuga

SEQ ID NO: 11979 - RNA, 1617 nt, Artificial Sequence
  derived and/or modified sequence opt1 from VP1__Norovirus_and/or_Norovirus-like__KM514064
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccagcgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccacaacuacaccaugaaccuggccagccagaacuggagcaacuacgacccgaccgaggagauccccgcgccccuggggacgcccgacuucgugggcaagauccaggggguccucacccagaccacccgcacggacggcuccacccgggggcacaaggccaccguguacaccggcagcgccgacuucgccccgaagcugggccgcgugcaguucgagacggacaccaaccacgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccggcgccgcuga

SEQ ID NO: 11980 - RNA, 1617 nt, Artificial Sequence
  derived and/or modified sequence opt1 from VP1__Norovirus_and/or_Norovirus-like__KJ649703
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucuccccgaagcugggccgcauccaguucgagacggacaccaaccacgacuucgaggccaaccagaacaccaaguucacccccgugggggucauccaggacggcgggacgacccaccggaacgagccccagcagugggugcugcccagcuacuccggccgcaacaccccgaacgugcaccucgcccccgccgucgcgcccaccuuccccggggagcagcugcuguucuuccggagcacgaugccgggcugcuccggcuaccccaacauggaccucgacugccugcugccccaggagugggugcaguacuucuaccaggaggccgcccccgcccagagcgacguggcgcuccugcgcuucgucaacccggacaccgggcgggugcuguucgagugcaagcuccacaaguccggcuacgugaccgucgcccacaccgggcagcacgaccuggugaucccgcccaacggcuacuuccgcuucgacagcugggugaaccaguucuacacccuggcccccauggggaacggcacgggccggcgccgcuga

SEQ ID NO: 11981 - RNA, 1617 nt, Artificial Sequence
  derived and/or modified sequence opt1 from VP1__Norovirus_and/or_Norovirus-like__KF177447
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaucaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcccccgcgguggcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 11982 - RNA, 1617 nt, Artificial Sequence
  derived and/or modified sequence opt1 from VP1__Norovirus_and/or_Norovirus-like__JX439820
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccagcucccgcaacuacaccaugaaccuggccagccagaacuggagcuccuacgacccgaccgaggagauccccgcgccccugggcacgcccgacuucgucgggaagauccagggcgugcucacccagaccacccggacggacgggagcacccgcggccacaaggccaccguguacaccggguccgccgacuucagcccgaagcugggccggguccaguucgacacggacaccgacaacgacuucgagaccaaccagaacaccaaguucacgcccgugggcgugauccaggacggguccaccaccuaccgcaacgagccccagcaguggguccugcccagcuacuccggccggaacacccacaacgugcaccucgccccggccguggcccccacguuccccggggagcagcugcuguucuuccgcagcaccaugcccggcugcuccggguacccgaacauggaccucgacugccugcugccccaggaguggguccaguacuucuaccaggaggccgcgcccgcccagagcgacguggcccuccugcgguucgugaaccccgacaccggccgcguccuguucgagugcaagcuccacaaguccggcuacgugaccguggcccacaccgggcagcacgaccuggucaucccgcccaacggcuacuuccgguucgacagcugggugaaccaguucuacacgcuggcgcccauggggaacggcaccgggcgccgccgguga

SEQ ID NO: 11983 - RNA, 1617 nt, Artificial Sequence
  derived and/or modified sequence opt1 from VP1__Norovirus_and/or_Norovirus-like__HF952120
augaagauggccagcuccgacgccaaccccagcgacggcuccaccgcgaaccuggugcccgaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggugaccauguucccccacaucaucguggacguccggcagcuggagcccgugcucgugccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccgcaacuacaccaugaaccuggccucccagaacuggaacagcuacgacccgaccgaggagauccccgcgccccuggggacgcccgacuucgugggcaagauccaggggguccucacccagaccacccggacggacggcagcacccgcgggcacaaggccaccguguacaccggcuccgccgacuucagcccgaagcugggccgggugcaguucgccacggacaccgacaacgacuucgaggccaaccagaacaccaaguucacccccgucggggugauccaggacggcuccacggcccaccgcaacgagccccagcagugggugcugcccagcuacuccgggcggaacauccacaacguccaccucgcgccggccguggcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaagccgggguacgucacgguggcccacaccggccagcacgaccuggugaucccgcccaacggguacuuccgguucgacuccugggucaaccaguucuacacccuggcccccaugggcaacgggaccggccgccgccgguga

SEQ ID NO: 11984 - RNA, 1617 nt, Artificial Sequence
  derived and/or modified sequence opt1 from VP1__Norovirus_and/or_Norovirus-like__KC517369
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccacggugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucgagaccgacaccgagaacgacuucgagacccaccagaacacgaaguucacccccgucggcgugauccaggacgggggcaccacccaccgcaacgagccccagcagugggugcuccccuccuacagcgggcggaacgucccgaacgugcaccuggcccccgccguggcccccacguuccccggcgagcagcuccucuucuuccgcuccaccaugccgggcugcagcggguaccccaacauggaccuggacugccugcucccccaggaguggguccagcacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcuga

SEQ ID NO: 11985 - RNA, 1617 nt, Artificial Sequence
  derived and/or modified sequence opt1 from VP1__Norovirus_and/or_Norovirus-like__KC409293
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccagaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 11986 - RNA, 1617 nt, Artificial Sequence
  derived and/or modified sequence opt1 from VP1__Norovirus_and/or_Norovirus-like__JX984951
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcgcuucuccacggacaccgagaacgacuucgagacccaccagaacaccaaguucacgcccgucggcgugauccaggacgggggcaccacccaccggaacgagccccagcagugggugcuccccaacuacagcggguccgacgucccgaacgugcaccuggcccccgccguggcgcccaacuuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 11987 - RNA, 1617 nt, Artificial Sequence
  derived and/or modified sequence opt1 from VP1__Norovirus_and/or_Norovirus-like__JX459612
augaagauggccagcuccgacgcccaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgagccgggacgggagcacccggggccacaaggccaccguguccaccgggagcgugcacuucacgccgaagcugggccgcguccaguucuccaccgacaccagcaacgacuucgagaccggccagaacacgcgguucacccccgugggggugguccaggacggcuccaccacccaccagaacgagccccagcagugggugcugcccaacuacagcgggcgcgacucccacaacgugcaccucgccccggccgucgcccccagcuuccccggcgagcagcugcuguucuuccgguccacgaugcccgggugcagcggcuacccgaacaugaaccucgacugccugcugccccaggagugggugcagcacuucuaccaggaggccgcgcccgcccaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcgcccaugggcaacgggacgggccggcgccgcuga

SEQ ID NO: 11988 - RNA, 1617 nt, Artificial Sequence
  derived and/or modified sequence opt1 from VP1__Norovirus_and/or_Norovirus-like__JX459604
augaagauggccagcaacgacgugacccccuccgacggcagcgccgcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgaggacguguucaccgucagcugccgcgugcugacccggcccuccccggacuucgacuucaucuuccucgugccgcccaccgucgagagccgcacgaagcccuucaccgugcccauccugaccguggaggagaugaccaacucccgguuccccaucccccuggagaagcuguucacgggccccagcggggccuucgucgugcagccgcagaacggccgcugcaccaccgacgggguccugcugggcaccacgcagcucucccccgugaacaucugcaccuuccggggcgacgugacccacaucgccgggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgagacccaccagaacacgaaguucacccccgugggggugauccaggacggcgggaccacccaccgcaacgagccccagcaguggguccuccccuccuacagcggccggaacgugcacaacgugcaccuggccccggccgucgcccccacguuccccggcgagcagcuccucuucuuccgcuccaccaugcccgggugcagcggcuacccgaacauggaccuggacugccugcucccccaggagugggugcagcacuucuaccaggaggcggcccccgcccaguccgacguggcccugcugcgguucgucaaccccgacaccgggcgcguccucuucgagugcaagcugcacaagagcggcuacgugaccguggcgcacaccgggcagcacgaccuggugaucccgcccaacggcuacuuccgguucgacuccugggugaaccaguucuacacgcucgcccccaugggcaacgggaccggccgccggcgcuga

SEQ ID NO: 11989 - RNA, 1617 nt, Artificial Sequence
  derived and/or modified sequence opt1 from VP1__Norovirus_and/or_Norovirus-like__JX155745
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccacccggggcgacggguccacgcgcggccacaaggccaccguguacaccggcagcgcccccuucaccccgaagauggggagcgugcaguucuccacggacaccgagaacgacuucgagacccaccagaacaccaaguucacgcccgucggcgugauccaggacgggggcaccacccaccggaacgagccccagcagugggugcugcccagcuacuccgggcgcaacgucccgaacgugcaccucgcccccgccguggcgcccaccuuccccggcgagcagcugcuguucuuccggagcacgaugccgggcugcuccggguaccccaacauggaccucgacugccugcugccccaggaguggguccagcacuucuaccaggaggccgcccccgcccagagcgacguggcgcuccugcgcuucgugaacccggacaccggccggguccuguucgagugcaagcuccacaaguccggguacgugaccguggcccacaccggccagcacgaccuggucaucccgcccaacggguacuuccgcuucgacagcugggugaaccaguucuacacccuggcccccaugggcaacggcacggggcggcgccgcuga

SEQ ID NO: 11990 - RNA, 1617 nt, Artificial Sequence
  derived and/or modified sequence opt1 from VP1__Norovirus_and/or_Norovirus-like__HM635155
augaagauggccagcuccgacaccaagaccagcgacggcuccacggccaaccuggugcccgaggucaacaacgaggugauggcgcucgagccgguggucggggccgccaucgccgcccccguggcgggccagcagaacgugaucgaccccuggauccgcaacaacuucguccaggcccccgggggcgaguucaccgugagcccgcggaacgcccccggggagauccugugguccgcgccccugggccccgaccucaacccguaccugagccaccuggcccgcauguacaacggcuacgccgggggcuucgaggugcaggucauccucgccgggaacgccuucaccgccggcaagaucaucuucgcggccgugccgcccaacuuccccaccgaggggcugucccccagccaggugacgauguucccccacaucaucgucgacgugcggcagcuggagcccgugcucaucccccugccggacguccgcaacaacuucuaccacuacaaccaguccaacgaccccaccaucaagcugaucgccaugcucuacacgccccugcgggccaacaacgccggcgacgacguguucaccgugagcugccgcguccugacccggcccuccccggacuucgacuucaucuuccucgugccgcccaccguggagagccgcaccaagcccuucuccguccccauccugaccguggaggagaugacgaacagccgguuccccaucccccuggagaagcuguucaccggccccuccagcgcguucgugguccagccgcagaacgggcgcugcaccaucgacggcgugcuccuggggaccacgcagcucucccccgucaacaucugcaccuuccggggcgacgugacccacaucaccggcagccgcaacuacacgaugaaccuggccacccagaacuggaacuccuacgaccccaccgaggagaucccggcgccccuggggacccccgacuucgugggcaagauccaggggguccucacgcagaccacccgggccgacggcagcacccgcgggcacaaggccacgguguacaccggcagcgccgacuucgcccccaagcugggccgggugcaguucgccaccgacaccgacaacgacuucgacgccaaccagaacacgaaguucaccccggucggggugauccaggacggcaacaccgcccaccgcaacgagccccagcagugggugcugcccuccuacagcgggcggaacucccacaacguccaccucgcgcccgccguggccccgaccuuccccggcgagcagcugcuguucuuccgcagcacgaugcccgggugcuccggcuaccccaacauggaccucgacugccugcugccgcaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 11991 - RNA, 1617 nt, Artificial Sequence
  derived and/or modified sequence opt1 from VP1__Norovirus_and/or_Norovirus-like__JN400620
augaagauggccagcaacgacgugaaccccuccgacggcagcgccgcgaaccugguccccgaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccggcucccgcaacuacaccaugaaccuggccagccugaacuggaacaacuacgaccccaccgaggagaucccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccgcaacgagccccagcaguggguccuccccagcuacuccgggcgggacgugccgaacgugcaccuggcccccgccgucgcccccaccuuccccggcgagcagcuccucuucuuccgcagcacgaugccgggcugcuccggguaccccaacauggaccuggacugccugcucccccaggagugggugcagcacuucuaccaggaggcggcccccgcccagagcgacguggcccugcugcgguucgucaacccggacaccggccgcguccucuucgagugcaagcugcacaaguccggguacgugaccguggcgcacaccggccagcacgaccuggugaucccgcccaacggguacuuccgguucgacagcugggugaaccaguucuacacccucgcccccaugggcaacggcacggggcgccggcgcuga

SEQ ID NO: 11992 - RNA, 1617 nt, Artificial Sequence
  derived and/or modified sequence opt1 from VP1__Norovirus_and/or_Norovirus-like__JQ613573
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgagcucccgcaacuacaccaugaaccuggccagccagaacuggaacagcuacgaccccaccgaggagauccccgcgccccugggcacgccggacuucgucgggaagauccagggcgugcucacccagaccacccggacggacggguccacccgcggccacaaggccaccguguacaccgggagcgccgacuucucccccaagcugggccggguccaguucgccacggacaccgacaacgacuucgagaccaaccagaacaccaaguucacgcccgugggcgugauccaggacgggagcaccacccaccgcaacgagccccagcaguggguccugccguccuacagcggccggaacauccacaacgugcaccucgcccccgccguggcccccaccuuccccggggagcagcugcuguucuuccgcuccacgaugccgggcugcagcggguaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcacggggcgccgccgguga

SEQ ID NO: 11993 - RNA, 1617 nt, Artificial Sequence
  derived and/or modified sequence opt1 from VP1__Norovirus_and/or_Norovirus-like__JQ478408
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcgcccaccagaacgagccccagcagugggugcugcccuccuacagcggccggaccgggcacaacguccaccucgccccggccguggcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaaguccggcuacgucaccguggcgcacaccggccagcacgaccuggugaucccgcccaacggguacuuccgguucgacagcugggucaaccaguucuacacgcuggcccccaugggcaacgggaccggccgccggcgcuga

SEQ ID NO: 11994 - RNA, 1617 nt, Artificial Sequence
  derived and/or modified sequence opt1 from VP1__Norovirus_and/or_Norovirus-like__EF684915
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaaguggaacaaguacgaccccaccgaggagaucccggcgccccucggcacgcccgacuucguggggaagauccagggcguccugacccagaccaccaagggggacggcagcacgcggggccacaaggccaccaucuacaccggguccgcccccuucaccccgaagcugggcagcgugcaguucagcacggacaccgagaacgacuucgagacccaccagaacaccaaguucacgcccgugggggucacccaggacggcuccaccacccaccgcaacgagccccagcagugggugcuccccagcuacuccgggcggaacgugcacaacguccaccuggccccggccguggcgcccacguuccccggcgagcagcuccucuucuuccgcagcaccaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacgcucgcccccaugggcaacggcaccgggcgccggcgcuga

SEQ ID NO: 11995 - RNA, 1617 nt, Artificial Sequence
  derived and/or modified sequence opt1 from VP1__Norovirus_and/or_Norovirus-like__HQ456331
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagacgccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcuga

SEQ ID NO: 11996 - RNA, 1617 nt, Artificial Sequence
  derived and/or modified sequence opt1 from VP1__Norovirus_and/or_Norovirus-like__HQ456322
augaagaucgccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccuccacccaggaguacaccaugaaccuggccagccagaacuggaacaacuacgacccgacggaggagauccccgcgccccugggcacccccgacuucgugggcaagauccaggggguccucacccagaccacgcggcgggacggcagcacccgcgggcacaaggccaccguguccaccggcagcgugcacuucacgccgaagcuggggcggauccaguucuccaccgacaccagcaacgacuucgagaccggccagaacacgcgcuucacccccgucggcguggugcaggacggguccaccacccaccagaacgagccccagcaguggguccugcccaacuacagcggccgggacucccacaacgugcaccucgccccggccguggcccccagcuuccccggggagcagcugcuguucuuccgcuccacgaugcccggcugcagcggguacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacggggcgccgccgguga

SEQ ID NO: 11997 - RNA, 1617 nt, Artificial Sequence
  derived and/or modified sequence opt1 from VP1__Norovirus_and/or_Norovirus-like__HM802551
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcucccgcaccuaccggaugaaccuggccagccagaacuggaacaacuacgaccccacggaggagaucccggcgccccuggggacccccgacuucgugggcaagauccaggggaugcucacccagaccacgaagggcgacgggagcacccgcggccacaaggccaccgucuccaccggcagcguggacuucacgcccaagcugggguccgugcaguucgccaccgacaccgacaacgacuucgagaccggccagaacacgcgguucaccccggucggggugauccaggacggcagcuccacccaccgcaacgagccccagcagugggugcugcccgacuacagcgggcggaccguccacaacgugcaccucgcccccgccguggccccgacguuccccggcgagcagcugcuguucuuccgcuccaccaugcccggcugcagcggguaccccaacauggaccucgacugccugcugccgcaggaguggguccagcacuucuaccaggaggccgcgcccucccagagcgacguggcccuccugcgguucgugaaccccgacaccggccgcguccuguucgagugcaagcuccacaaggccggguacgugaccguggcccacaccggccagcacgaccuggucaucccgcccaacggguacuuccgguucgacuccugggugaaccaguucuacacgcuggcgcccaugggcaacggcgccgggcgccgccgguga

SEQ ID NO: 11998 - RNA, 1617 nt, Artificial Sequence
  derived and/or modified sequence opt1 from VP1__Norovirus_and/or_Norovirus-like__HM802546
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcacccgcacguaccggaugaaccuggccucccagaacuggaacaacuacgaccccaccgaggagaucccggcgccccuggggacccccgacuucgugggcaagauccaggggaugcucacccagacgaccaagggcgacgggagcacccgcggccacaaggccaccgucagcacgggcuccguggacuucacccccaagcuggggagcgugcaguucgccaccgacaccgacaacgacuucgagacgggccagaacacccgguucaccccggucggggugauccaggacggcuccagcgcccaccgcaacgagccccagcagugggugcugcccgacuacuccgggcggaccguccacaacgugcaccucgcccccgccguggccccgacguuccccggcgagcagcugcuguucuuccgcagcaccaugcccggcugcuccggguaccccaacauggaccucgacugccugcugccgcaggaguggguccagcacuucuaccaggaggcggcccccagccaguccgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacagcugggugaaccaguucuacacgcuggcccccaugggcaacggcgccgggcgccgccgguga

SEQ ID NO: 11999 - RNA, 1617 nt, Artificial Sequence
  derived and/or modified sequence opt1 from VP1__Norovirus_and/or_Norovirus-like__GQ856453
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggccauccucgccgggaacgccuucaccgccggcaagaucaucuucgccgccgucccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgcgaugcucuacacgccccugcgggccaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccuccuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagccuccaguucuccacggacaccgagaacgacuucgagacccaccagaacaccaaguucacgcccgugggcgugauccaggacgggggcaccacccaccgcaacgagccccagcaguggguccugcccagcuacuccgggcggaacgugccgaacgugcaccuggcccccgccgucgcccccaccuuccccggcgagcagcuccuguucuuccgcagcacgaugccgggcugcuccggguaccccaacauggaccuggacugccuccugccccaggagugggugcagcacuucuaccaggaggccgcccccgcgcagagcgacguggcccugcuccgguucgucaacccggacaccggccgcgugcuguucgagugcaagcugcacaaguccggguacgugaccgucgcccacaccggccagcacgaccucgugaucccgcccaacggguacuuccgguucgacagcugggugaaccaguucuacacccuggcccccaugggcaacggcacggggcgccggcgcuga

SEQ ID NO: 12000 - RNA, 1617 nt, Artificial Sequence
  derived and/or modified sequence opt1 from VP1__Norovirus_and/or_Norovirus-like__GQ856445
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagagcgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacgucgaccuggacugccugcucccccaggagugggugcagcacuucuaccaggaggccgcccccgcccaguccgacguggcgcugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgccggcgcuga

SEQ ID NO: 12001 - RNA, 1617 nt, Artificial Sequence
  derived and/or modified sequence opt1 from VP1__Norovirus_and/or_Norovirus-like__AB541358
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccugauccugaccguggaggagaugaccaacucccgguuccccaucccccucgagaagcuguucaccggccccagcuccgccuucgugguccagccccagaacgggcgcugcacgaccgacggcgugcugcucgggaccacccagcugagcccggucaacaucugcacguuccggggcgacgugacccacaucgccggcucccgcaacuacaccaugaaccuggccagccucaacuggaacaacuacgaccccaccgaggagauccccgcgccgcuggggacgcccgacuucgugggcaagauccaggggguccugacccagaccaccaagggcgacggguccacgcggggccacaaggccaccguguacaccggcagcgcccccuucacccccaagcucgggagcgugcaguucuccacggacaccgagaacgacuucgagauccaccagaacaccaaguucaccccggucggcgugauccaggacgggagcacgacccaccgcaacgagccccagcagugggugcugcccuccuacagcggccggaacguccacaacgugcaccuggcccccgccguggcgccgaccuuccccggggagcagcuccuguucuuccgcuccaccaugcccggcugcagcggcuaccccaacauggaccuggacugccuccugccgcaggaguggguccagcacuucuaccaggaggccgcccccgcccaguccgacguggcgcugcuccgguucgugaaccccgacacggggcgcguccuguucgagugcaagcugcacaagagcggcuacgugaccguggccuacaccgggcagcacgaccucgucaucccgcccaacggcuacuuccgguucgacuccugggugaaccaguucuacacccuggcccccauggggaacggcaccggccgccggcgcuga

SEQ ID NO: 12002 - RNA, 1617 nt, Artificial Sequence
  derived and/or modified sequence opt1 from VP1__Norovirus_and/or_Norovirus-like__AB541349
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccacccccuucacgccgaagcugggcagcgugcaguucagcaccgacaccgagaacgacuucgagacccaccagaacacgaaguucacccccgucggggugauccaggacggcuccaccauccaccgcaacgagccccagcagugggugcuccccagcuacuccgggcggaacguccagaacgugcaccuggccccggccguggcccccaccuuccccggcgagcagcuccucuucuuccgcagcacgaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacccucgcccccaugggcaacggcacggggcgccggcgcuga

SEQ ID NO: 12003 - RNA, 1617 nt, Artificial Sequence
  derived and/or modified sequence opt1 from VP1__Norovirus_and/or_Norovirus-like__AB541342
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcccccuccggcccggaccugaaccccuaccucagccaccuggcccgcauguucaacgacuacgccggcggguucgaggugcaggucauccuggccggcaacgcguucacggccgggaagaucaucuucgccgccgugccgcccaacuucccgaccgagggccucucccccagccaggugaccauguucccccacaucaucgucgacgugcggcagcuggagcccgugcugaucccgcuccccgacguccgcaacaacuucuaccacuacaaccaguccaacgacagcaccaucaagcugaucgccaugcuguacacgccccuccgggcgaacaacgccggggaggacguguucaccguguccugccgcguccugacccggcccagcccggacuucgacuucaucuuccuggugccgcccaccguggagucccgcacgaagcccuucaccguccccauccucaccguggaggagaugaccaacagccgguuccccaucccccuggagaagcuguucacgggccccuccggcgccuucgugguccagccgcagaacgggcgcugcaccaccgacggcgugcuccuggggaccacgcagcugagccccgucaacaucugcaccuuccggggcgacgugacccacaucgccggcucccgcaacuacaccaugaaccucgccagccugaacuggaacaacuacgaccccacggaggagaucccggcgccccuggggacccccgacuucgugggcaagauccaggggguccucacccagaccacgaagggcgacggguccacccggggccacaaggccaccguguacaccggcagcgcccccuucacgccgaagcuggggagcgugcaguucuccaccgacaccgagaacgacuucgaggcccaccagaacaccaaguucacgcccgucggcgugauccaggacgggagcaccacccaccgcaacgagccccagcagugggugcugcccuccuacagcggccggaacguccagaacgugcaccucgccccggcgguggcccccaccuuccccggggagcagcugcuguucuuccgcuccacgaugcccggcugcagcggcuacccgaacauggaccucgacugccugcugccccaggaguggguccagcacuucuaccaggaggccgcccccgcgcaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacgggccgccggcgcuga

SEQ ID NO: 12004 - RNA, 1617 nt, Artificial Sequence
  derived and/or modified sequence opt1 from VP1__Norovirus_and/or_Norovirus-like__AB541248
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacagcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggggaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacggccgcugcacgaccgacggggugcugcugggcaccacccagcucucccccgucaacaucugcacguuccgcggggacgugacccacaucgccggcagccggaacuacaccaugaaccuggccucccugaacuggaacaacuacgaccccaccgaggagaucccggcgccccucggcacgcccgacuucguggggaagauccagggcguccugacccagaccaccaagggggacggcagcacgcgggggcacaaggccaccguguacaccggcagcgcccccuucaccccgaagcugggcuccgugcaguucagcacggacaccgagaacgacuucgagacccaccagaacaccaaguucacgcccgucggggugauccaggacggcgggaccacccaccgcaacgagccccagcagugggugcuccccuccuacagcggccgggacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcuga

SEQ ID NO: 12005 - RNA, 1617 nt, Artificial Sequence
  derived and/or modified sequence opt1 from VP1__Norovirus_and/or_Norovirus-like__GQ246798
augaagauggccagcuccgacgccaaccccuucgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgguga

SEQ ID NO: 12006 - RNA, 1617 nt, Artificial Sequence
  derived and/or modified sequence opt1 from VP1__Norovirus_and/or_Norovirus-like__GQ246791
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccggaucaucgucgacgugcgccagcuggagcccgugcucaucccgcugcccgacguccggaacaacuucuaccacuacaaccagagcaacgaccccaccaucaagcugaucgccaugcucuacacgccccugcgcgccaacaacgcgggcgacgacguguucaccguguccugccggguccugacccgcccgagccccgacuucgacuucaucuuccucgugccgcccaccguggagucccggacgaagcccuucaccguccccauccugaccguggaggagaugaccaacagccgcuuccccaucccccuggagcggcucuacacgggcccguccagcgccuucgugguccagccccagaacgggcgcugcaccaccgacggcgugcugcuggggaccacgcagcucuccgccgucaacaucugcaccuuccggggcgacgugacccacaucgccggcagccgcaacuacaccaugaaccuggccucccagaacuggaacaacuacgaccccacggaggagaucccggcgccccuggggacccccgacuucgugggcaagauccaggggaugcucacccagaccacgcggagcgacggcuccacccgcgggcacaaggccaccguccugaccggcagcgccgacuucgcccccaagcugggccgggugcaguucgccacggacaccgacaacgacuucgagagcgggcagaacaccaaguucaccccggugggcgucauccaggacggguccacgacccaccgcaacgagccccagcagugggugcuccccaacuacagcggccggaccgggcacaacgugcaccuggcgcccgccgucgccccgaccuaccccggcgagcagcuccuguucuuccgcuccacgaugcccggcugcagcggguaccccaacauggaccuggacugccugaucccgcaggacugggugcagcacuucuaccaggaggccgcgcccgcccaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacggcacggggcggcgccgguga

SEQ ID NO: 12007 - RNA, 1617 nt, Artificial Sequence
  derived and/or modified sequence opt1 from VP1__Norovirus_and/or_Norovirus-like__GU350225
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccacccaccgcaacgagccccagcagugggugcugcccgacuacagcgggcggacggcccacaacguccaccucgccccggccguggcccccaccuuccccggcgagcagcugcuguucuuccgcuccaccaugcccggcugcagcggguacccgaacauggaccucgacugccugcugccccaggagugggugcagcacuucuaccaggaggcggcccccucccagagcgacgucgcccuccugcgguucgugaaccccgacaccggccgcgugcuguucgagugcaagcuccacaaggccggguacgucaccguggcgcacacgggccagcacgaccuggugaucccgcccaacggguacuuccgguucgacuccugggucaaccaguucuacacccuggcccccaugggcaacggcgccgggcgccgccgguga

SEQ ID NO: 12008 - RNA, 1617 nt, Artificial Sequence
  derived and/or modified sequence opt1 from VP1__Norovirus_and/or_Norovirus-like__AB504319
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggaggugaccaacucccgguuccccaucccccuggagaagcuguucaccggccccagcggggccuucgucgugcagccgcagaacggccgcugcacgaccgacgggguccugcugggcaccacccagcucucccccgugaacaucugcacguuccggggcgacgugacccacaucgccgggacccgcaacuacaccaugaaccuggccagccugaacuggaacaacuacgaccccacggaggagaucccggcgccccucggcacccccgacuucgucgggaagauccagggcgugcugacccagaccacgaagggggacggcuccacccggggccacaaggccaccguguacaccgggagcgcccccuucacgccgaagcugggcuccguccaguucagcaccgacaccgagaacgacuucgagacccaccagaacacgaaguucacccccgugggggugauccaggacggcgggaccacccaccgcaacgagccccagcaguggguccuccccagcuacuccggccggaacgugcacaacgugcaccuggccccggccgucgcgcccacguuccccggcgagcagcuccucuucuuccgcagcaccaugcccgggugcuccggcuacccgaacauggaccuggacugccugcucccccaggagugggugcagcacuucuaccaggaggccgcccccgcccagagcgacguggcgcugaugcgguucgucaaccccgacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacgcuggcccccaugggcaacgggaccggccgccggcgcuga

SEQ ID NO: 12009 - RNA, 1617 nt, Artificial Sequence
  derived and/or modified sequence opt1 from VP1__Norovirus_and/or_Norovirus-like__AB447458
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacggccgcugcacgaccgacgggguccuccugggcaccacccagcucagccccgugaacaucugcacguuccgcggggacgugacccacaucgccggcacccaggaguacaccaugaaccuggccucccagaacuggaacaacuacgacccgacggaggagauccccgcgccccugggcacccccgacuucgucgggaagauccagggcgugcucacccagaccacgcggcgggacgggagcacccgcggccacaaggccaccgugagcaccggguccguccacuucacgccgaagcugggccggauccaguucagcaccgacaccuccaacgacuucgagaccggccagaacacgcgcuucacccccgugggggugguccaggacggcgggaccacccaccagaacgagccccagcagugggugcugcccaacuacagcggccgggacucccacaacgugcaccucgccccggccgucgcccccagcuuccccggggagcagcugcuguucuuccgcuccacgaugcccggcugcagcggcuacccgaacaugaaccucgacugccugcugccccaggagugggugcagcacuucuaccaggaggccgcgcccgcccaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcgcccauggggaacggcacgggccgccgccgguga

SEQ ID NO: 12010 - RNA, 1617 nt, Artificial Sequence
  derived and/or modified sequence opt1 from VP1__Norovirus_and/or_Norovirus-like__AB385640
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacagcuacgccggcggguucgaggugcaggucauccucgccggcaacgccuucacggccgggaagaucaucuucgcggccgugccgcccaacuucccgaucgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgccggggacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccacccccguggagaagcuguucaccggcccguccagcgcguucaucguccagccccagaacggccgcugcacgaucgacggggugcuccugggcaccacccagcugucccccgucaacaucugcaccuuccgcggggacgugacgcacaucgccggcacccaggaguacaccaugaaccucgccagccagaacuggaacaacuacgacccgaccgaggagauccccgcgccccugggcacgcccgacuucguggggaagauccagggcguccugacccagaccacccggcgggacgggagcacgcgcggccacaaggccaccguguccaccgggagcgugcacuucaccccgaagcucggccggauccaguucuccacggacaccagcaacgacuucgagacccgccagaacacccgguucacgcccgucggcgugauccaggacggguccaccacccaccagaacgagccccagcagugggugcugcccaacuacagcggccgcgacucccacaacguccaccuggccccggccguggcccccagcuuccccggggagcagcuccuguucuuccgguccaccaugcccggcugcagcggguacccgaacaugaaccuggacugccuccugccccaggagugggugcagcacuucuaccaggaggccgcccccgcgcaguccgacgucgcccugcuccgcuucgugaaccccgacacgggccgggugauguucgagugcaagcugcacaagagcggcuacaucaccgucgcccacaccgggcagcacgaccuggugaucccgcccaacggcuacuuccgcuucgacgccugggugaaccaguucuacacccucgcgcccauggggaacggcaccgggcgccggcgcuga

SEQ ID NO: 12011 - RNA, 1617 nt, Artificial Sequence
  derived and/or modified sequence opt1 from VP1__Norovirus_and/or_Norovirus-like__AB385633
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaacgcgggcgacgacguguucaccgucuccugccgcgugcugacccggcccagcccggacuucgacuucaucuuccucgugccgcccaccgucgagucccgcacgaagcccuucagcgugcccauccugaccguggaggagaugaccaacucccgguuccccaucccccuggagaagcuguucaccggccccagcuccgccuucaucguccagccgcagaacgggcgcugcacgaccgacggcgugcugcuggggaccacccagcucagccccgucaacaucugcacguuccggggcgacgugacccacaucgccggcacccaggaguacaccaugaaccuggccucccagaacuggaacaacuacgaccccacggaggagaucccggcgccccuggggacccccgacuucgugggcaagauccaggggguccucacccagaccacgcgccgggacggcagcacccgcgggcacaaggccaccgugagcaccggcuccgugcacuucacgcccaagcugggccggauccaguucagcaccgacaccuccaacgacuucgagaccgggcagaacacgcgcuucaccccggucggcguggugcaggacgggagcaccacccaccagaacgagccccagcaguggguccugcccaacuaccucggccgggacucccacaacgugcaccuggcccccgccguggccccgagcuuccccggggagcagcuccucuucuuccgcuccacgaugcccggcugcagcggcuaccccaacaugaaccuggacugccugcucccgcaggaguggguccagcacuucuaccaggaggccgcgcccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcgcccauggggaacggcacgggccgccgccgguga

SEQ ID NO: 12012 - RNA, 1617 nt, Artificial Sequence
  derived and/or modified sequence opt1 from VP1__Norovirus_and/or_Norovirus-like__DQ658413
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgacacccacaacuacacgaugaaccuggccucccagaacuggaacaacuacgacccgaccgaggagauccccgcgccccuggggacccccgacuucgugggcaagauccaggggaugcucacccagacgacccgcggcgacgggagcacccggggccacaaggccaccgucuccacgggcgacgugcacuucaccccgaagcuggggagcauccaguucaacaccgacaccaacaacgacuucgagacgggccagaacaccaaguucacccccgugggggucgugcaggacggcaacgggacccaccagaacgagccccagcagugggugcugcccuccuacagcggccgcacgggccacaacguccaccucgccccggccguggcccccaccuuccccggggagcagcugcuguucuuccggagcaccaugcccggcugcuccggguacccgaacaugaaccucgacugccugcugccccaggagugggugcagcacuucuaccaggaggccgcgcccgcccagagcgacgucgcccuccugcgcuucgugaaccccgacaccggccgggugcuguucgagugcaagcuccacaaguccggguacgucaccguggcccacacgggccagcacgaccuggugaucccgcccaacggcuacuuccgcuucgacagcugggucaaccaguucuacacccuggcgcccauggggaacggcaccgggcggcgccgguga

SEQ ID NO: 12013 - RNA, 1617 nt, Artificial Sequence
  derived and/or modified sequence opt1 from VP1__Norovirus_and/or_Norovirus-like__AB220923
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcacccgcacguaccggaugaaccuggccucccagaacuggaacaacuacgaccccaccgaggagaucccggcgccccuggggacccccgacuucgugggcaagauccaggggaugcucacccagacgaccaagggcgacgggagcacccgcggccacaaggccaccgucagcacgggcuccguggacuucacccccaagcuggggagcgugcaguucgccaccgacaccgacaacgacuucgagacgggccagaacacccgguucaccccggucggggugauccaggacggcuccagcacccaccgcaacgagccccagcagugggugcugcccgacuacuccgggcggacgguccacaacgugcaccucgcccccgccguggccccgaccuuccccggcgagcagcugcuguucuuccgcagcaccaugcccggcugcuccggguaccccaacauggaccucgacugccugcugccgcaggaguggguccagcacuucuaccaggaggccgcgcccagccaguccgacguggcccuccugcgguucgugaaccccgacaccggccgcguccuguucgagugcaagcuccacaaggccggguacgugaccguggcccacacgggccagcacgaccuggucaucccgcccaacggguacuuccgguucgacagcugggugaaccaguucuacacccuggcgcccaugggcaacggcgccgggcgccgccgguga

SEQ ID NO: 12014 - RNA, 1617 nt, Artificial Sequence
  derived and/or modified sequence opt1 from VP1__Norovirus_and/or_Norovirus-like__AY588016
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccggacggggcacaacguccaccucgccccggccguggcccccaccuuccccggcgagcagcugcuguucuuccgcagcgccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaaguccggcuacgucaccguggcgcacaccggccagcacgaccuggugaucccgcccaacggguacuuccgguucgacagcugggucaaccaguucuacacgcuggcccccaugggcaacgggaccggccgccggcgcuga

SEQ ID NO: 12015 - RNA, 1617 nt, Artificial Sequence
  derived and/or modified sequence opt1 from VP1__Norovirus_and/or_Norovirus-like__AY502022
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccggacggggcacaacguccaccucgccccggccguggcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacgucgcccuccugcgguucgugaaccccgacaccgggcgcgugcuguucgagugcaagcuccacaaguccggcuacgucaccguggcccacacgggccagcacgaccuggugaucccgcccaacggguacuuccgguucgacagcugggucaaccaguucuacacccuggcgcccaugggcaacgggaccggccgccggcgcuga

SEQ ID NO: 12016 - RNA, 1617 nt, Artificial Sequence
  derived and/or modified sequence opt1 from VP1__Norovirus_and/or_Norovirus-like__KX158280
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 12017 - RNA, 1617 nt, Artificial Sequence
  derived and/or modified sequence opt1 from VP1__Norovirus_and/or_Norovirus-like__KX371606
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 12018 - RNA, 1617 nt, Artificial Sequence
  derived and/or modified sequence opt1 from VP1__Norovirus_and/or_Norovirus-like__KX371605
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagagcaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 12019 - RNA, 1617 nt, Artificial Sequence
  derived and/or modified sequence opt1 from VP1__Norovirus_and/or_Norovirus-like__KX354128
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggcugcugacccagaccaccaagggcgacggguccacgcggggccacaaggccaccgucuacaccggcagcgcccccuucaccccgaagcucgggagcgugcaguucgagacggacaccgagaacgacuucgagacccaccagaacaccaaguucacgcccgugggcgucauccaggacgggggcaccacccaccgcaacgagccccagcagugggugcugcccuccuacagcgggcggaacgugccgaacguccaccuggcccccgccguggcgcccaccuuccccggcgagcagcuccuguucuuccgcuccacgaugccgggcugcagcggguaccccaacauggaccuggacugccuccugccccaggagugggugcagcacuucuaccaggaggccgcccccgcccaguccgacgucgcgcugcuccgguucgugaacccggacaccggccgcgugcuguucgagugcaagcugcacaagagcggguacgucaccguggcccacaccggccagcacgaccucgugaucccgcccaacggguacuuccgguucgacuccugggucaaccaguucuacacccuggcccccaugggcaacggcacggggcgccggcgcuga

SEQ ID NO: 12020 - RNA, 1617 nt, Artificial Sequence
  derived and/or modified sequence opt1 from VP1__Norovirus_and/or_Norovirus-like__KX354099
augaagauggccagcuccgacgccagccccuccgacggcagcgcggccucccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccagcugaacgaccccaccaucaagcucaucgccaugcuguacacgccccugcgggcgaacaacgccggcgacgacgucuucaccguguccugccgcgugcucacccggccgagccccgacuucgacuucaucuuccuggucccgcccaccguggagucccgcaccaagcccuucagcgugcccguccugacgguggaggagaugaccaacucccgguuccccaucccccucgagaagcuguucaccggcccgagcuccgccuucgucgugcagccccagaacgggcgcugcaccacggacggcgugcugcucgggaccacccagcugagccccgucaacaucugcaccuuccggggcgacgugacgcacaucaccggcucccacaacuacaccaugaaccuggccagccagaacuggaacaacuacgacccgaccgaggagauccccgcgccccucgggacgcccgacuucgugggcaagauccaggggguccugacccagaccacccgcgccgacggcagcacgcgggggcacaaggccaccguguacaccggcuccgccgacuucgccccgaagcugggccgcgugcaguucgagaccgacacggaccacgacuucgagaccaaccagaacaccaaguucacccccgucggggugauccaggacggcgggacgacccaccggaacgagccccagcagugggugcuccccagcuacuccggccgcaacacccacaacguccaccuggccccggcgguggcccccaccuuccccggggagcagcuccuguucuuccggagcacgaugcccggcugcuccggcuacccgaacauggaccuggacugccugcucccccaggagugggugcaguacuucuaccaggaggccgcccccgcgcagagcgacgucgcccugcugcgcuucgugaaccccgacaccgggcggguccucuucgagugcaagcugcacaaguccggcuacgugaccguggcccacaccgggcagcacgaccuggugaucccgcccaacggcuacuuccgcuucgacagcugggucaaccaguucuacacccucgcccccauggggaacggcgccggccggcgccgcuga

SEQ ID NO: 12021 - RNA, 1617 nt, Artificial Sequence
  derived and/or modified sequence opt1 from VP1__Norovirus_and/or_Norovirus-like__KX354087
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcuguucacgguccccauccugaccguggaggagaugaccaacucccgguuccccaucccccucgagaagcuguucaccggccccagcuccgccuucgugguccagccccagaacgggcgcugcacgaccgacggcgugcugcucgggaccacccagcugagcccggucaacaucugcacguuccggggcgacgugacccacaucgccggcucccgcaacuacaccaugaaccuggccagccucaacuggaacaacuacgaccccaccgaggagauccccgcgccgcuggggacgcccgacuucgugggcaagauccaggggguccugacccagaccaccaagggcgacggguccacgcggggccacaaggccaccguguacaccggcagcgccgacuucacccccaagcucgggagcgugcaguucgccacggacaccgagaacgacuucgagauccaccagaacacccgcuucacccccgucggcgugauccaggacgggggcacgacccaccggaacgagccgcagcagugggugcugcccuccuacagcgggcgcaacguccacaacgugcaccuggcccccgcgguggcccccaacuucccgggcgagcagcuccuguucuuccgguccaccaugcccggcugcagcggguaccccaacauggaccuggacugccuccugccccaggaguggguccagcacuucuaccaggaggccgccccggcgcaguccgacguggcccugcuccgcuucgugaaccccgacaccggccggguccuguucgagugcaagcugcacaagagcggguacgugacgguggcccacaccggccaguacgaccucgucaucccgcccaacggguacuuccgcuucgacuccugggugaaccaguucuacacccuggcccccaugggcaacggcaccgggcggcgccgcuga

SEQ ID NO: 12022 - RNA, 1617 nt, Artificial Sequence
  derived and/or modified sequence opt1 from VP1__Norovirus_and/or_Norovirus-like__KX354009
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 12023 - RNA, 1617 nt, Artificial Sequence
  derived and/or modified sequence opt1 from VP1__Norovirus_and/or_Norovirus-like__KR131784
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaacauggccucccagaacuggaacaacuacgacccgaccgaggagauccccgcgccccuggggacgcccgacuucgugggcaagauccaggggguccugacccagaccacccggacggacggcagcacccgcgggcacaaggccaccguguacaccggcagcgccgacuucgccccgaagcucggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccuggccccggcgguggcccccaccuuccccggcgagcagcuccuguucuuccgcagcacgaugcccgggugcuccggcuacccgaacauggaccuggacugccuccugccccaggagugggugcaguacuucuaccaggaggccgcccccgcgcagagcgacgucgcccugcuccgguucgugaaccccgacaccggccgcgugcuguucgagugcaagcugcacaaguccggguacgucaccguggcccacaccggccagcacgaccucgugaucccgcccaacggguacuuccgguucgacagcugggucaaccaguucuacacccuggcccccaugggcaacgggacgggccgccgccgguga

SEQ ID NO: 12024 - RNA, 1617 nt, Artificial Sequence
  derived and/or modified sequence opt1 from VP1__Norovirus_and/or_Norovirus-like__AB972527
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcuacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccgccggcgcuga

SEQ ID NO: 12025 - RNA, 1617 nt, Artificial Sequence
  derived and/or modified sequence opt1 from VP1__Norovirus_and/or_Norovirus-like__AB972525
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgccguggcgcccaccuuccccggcgagcagcuccucuucuuccgcuccacggugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 12026 - RNA, 1617 nt, Artificial Sequence
  derived and/or modified sequence opt1 from VP1__Norovirus_and/or_Norovirus-like__KT780388
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccacaacuacaccaugaaccuggccucccagaacuggagcaacuacgacccgacggaggagauccccgcgccccuggggacccccgacuucgugggcaagauccaggggguccucacccagaccacgcgcaccgacggcagcacccgggggcacaaggccaccguguacacgggcuccgccgacuucgccccgaagcugggccgcgugcaguucgccaccgacaccgaccacgacuucgaggccaaccagaacaccaaguucacgcccgucggggugauccaggacggcgggaccacccaccggaacgagccccagcagugggugcugcccagcuacuccggccgcaacaccccgaacguccaccucgcgcccgccguggcccccacguuccccggggagcagcugcuguucuuccggagcaccaugccgggcugcuccggcuaccccaacauggaccucgacugccugcugccccaggagugggugcaguacuucuaccaggaggccgcgcccgcccagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccggcgccgcuga

SEQ ID NO: 12027 - RNA, 1617 nt, Artificial Sequence
  derived and/or modified sequence opt1 from VP1__Norovirus_and/or_Norovirus-like__KT780373
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgccacggacaccgaccacgacuucgucgccaaccagaacaccaaguucacccccgugggggugauccaggacggcgggacgacccaccggaacgagccccagcaguggguccugcccagcuacuccggccgcaacaccccgaacgugcaccucgcgcccgccguggcccccaccuuccccggggagcagcugcuguucuuccggagcacgaugccgggcugcuccggcuaccccaacauggaccucgacugccugcugccccaggaguggguccaguacuucuaccaggaggccgcgcccgcccagagcgacguggcccuccugcgcuucgugaacccggacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcccccauggggaacggcacgggccggcgccgcuga

SEQ ID NO: 12028 - RNA, 1617 nt, Artificial Sequence
  derived and/or modified sequence opt1 from VP1__Norovirus_and/or_Norovirus-like__AB933723
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacagcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggggaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacggccgcugcacgaccgacggggugcugcugggcaccacccagcucucccccgucaacaucugcacguuccgcggggacgugacccacaucgccagcucccggaacuacaccaugaaccuggccagccugaacuggaacaacuacgaccccaccgaggagaucccggcgccccucggcacgcccgacuucgugggcaagauccaggggaugcugacccagaccaccaagggcgacgggagcacgcggggccacaaggccaccgucuacaccggguccgcccccuucaccccgaagcugggcagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcgcccgccuuccccggggagcagcuccucuucuuccgcuccaccaugccgggcugcagcggguaccccaacauggaccuggacugccugcucccccaggagugggugcagcacuucuaccaggaggccgcccccgcgcaguccgacgucgcccugcugcgguucgugaacccggacacgggccgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcaccgggcgccggcgcuga

SEQ ID NO: 12029 - RNA, 1617 nt, Artificial Sequence
  derived and/or modified sequence opt1 from VP1__Norovirus_and/or_Norovirus-like__AB933708
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcgcccccuucaccccgaagcugggguccgugcaguucagcacggacaccgagaacgacuucgagacccaccagaacaccaaguucacgcccgugggcgucauccaggacggguccaccacccaccgcaacgagccccagcagugggugcuccccagcuacuccggccggaacgugccgaacguccaccuggcccccgccguggcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacgucgcgcugcugcgguucgugaacccggacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcuga

SEQ ID NO: 12030 - RNA, 1617 nt, Artificial Sequence
  derived and/or modified sequence opt1 from VP1__Norovirus_and/or_Norovirus-like__LC066046
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccacaacuacaccaugaaccuggccucccagaacuggagcaacuacgacccgacggaggagauccccgcgccccuggggacccccgacuucgugggcaagauccaggggguccucacccagaccacgcgcaccgacggcagcacccgggggcacaaggccaccguguacacgggcuccgccgacuucgccccgaagcugggccgcgugcaguucgagaccgacaccaaccacgacuucgaggccaaccagaacaccaaguucacgcccgucggggugauccaggacggcgggaccacccaccggaacgagccccagcagugggugcugcccagcuacuccggccgcaacaccccgaacguccaccucgcccccgcgguggcccccacguuccccggggagcagcugcuguucuuccggagcaccaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccggcgccgcuga

SEQ ID NO: 12031 - RNA, 1617 nt, Artificial Sequence
  derived and/or modified sequence opt1 from VP1__Norovirus_and/or_Norovirus-like__KJ678140
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacguggugaucgacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgagaccaaccagaacaccaaguucacgcccgucggggugauccaggacggcgggaccacccaccgcaacgagccccagcagugggugcugcccuccuacagcggccggaacaccccgaacguccaccucgcccccgccguggcgcccacguuccccggggagcagcugcuguucuuccgcuccaccaugccgggcugcagcggcuaccccaacauggaccucgacugccugcugccccaggagugggugcaguacuucuaccaggaggccgcccccgcccaguccgacgucgcgcuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgguga

SEQ ID NO: 12032 - RNA, 1617 nt, Artificial Sequence
  derived and/or modified sequence opt1 from VP1__Norovirus_and/or_Norovirus-like__KJ678139
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 12033 - RNA, 1617 nt, Artificial Sequence
  derived and/or modified sequence opt1 from VP1__Norovirus_and/or_Norovirus-like__EU921383
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgaggcccaccagaacaccaaguucacccccgucggggugauccaggacggcgggacgacccaccgcaacgagccccagcagugggugcuccccagcuacuccggccggaacguccacaacgugcaccuggccccggcgguggcccccaccuuccccggcgagcagcuccucuucuuccgcagcaccaugcccgggugcuccggcuacccgaacauggaccuggacugccugcucccccaggaguggguccagcacuucuaccaggaggccgcccccgcgcagagcgacguggcccugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggaccggccgccggcgcuga

SEQ ID NO: 12034 - RNA, 1617 nt, Artificial Sequence
  derived and/or modified sequence opt1 from VP1__Norovirus_and/or_Norovirus-like__KP176405
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggagcucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccgccggcgcuga

SEQ ID NO: 12035 - RNA, 1617 nt, Artificial Sequence
  derived and/or modified sequence opt1 from VP1__Norovirus_and/or_Norovirus-like__KP176403
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacacccgcuucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcagcacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcuga

SEQ ID NO: 12036 - RNA, 1617 nt, Artificial Sequence
  derived and/or modified sequence opt1 from VP1__Norovirus_and/or_Norovirus-like__KP096343
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccgucccccuggagaagcuguucaccggcccguccagcgccuucguggugcagccccagaacgggcgcugcaccacggacggcguccuccuggggaccacccagcucucccccgugaacaucugcaccuuccggggcgacgugacgcacaucaccggcagccacaacuacaccaugaaccuggccucccagaacuggagcaacuacgacccgaccgaggagauccccgcgccccuggggacgcccgacuucgucggcaagauccagggggugcucacccagaccacccgcacggacggcagcacccgggggcacaaggccaccguguacaccggcuccgccgacuucgccccgaagcugggccgcguccaguucgagacggacaccgaccgggacuucgaggccaaccagaacaccaaguucacccccgugggggugauccaggacggcgggacgacccaccgcaacgagccccagcaguggguccugcccagcuacuccggccggaacaccccgaacgugcaccucgcccccgcgguggcccccaccuuccccggggagcagcugcuguucuuccgcagcacgaugccgggcugcuccggcuaccccaacauggaccucgacugccugcugccccaggaguggguccaguacuucuaccaggaggccgcccccgcgcagagcgacguggcccuccugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcacgggccgccgccgguga

SEQ ID NO: 12037 - RNA, 1617 nt, Artificial Sequence
  derived and/or modified sequence opt1 from VP1__Norovirus_and/or_Norovirus-like__KM268101
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcauccaguucgagacggacaccaaccacgacuucgaggccaaccagaacaccaaguucacccccgugggggucauccaggacggcgggacgacccaccggaacgagccccagcagugggugcugcccuccuacagcggccgcaacaccccgaacgugcaccucgcccccgcggucgcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacguggcccuccugcgcuucgucaacccggacaccgggcgggugcuguucgagugcaagcuccacaagagcggcuacgugaccgucgcccacaccgggcagcacgaccuggugaucccgcccaacggcuacuuccgcuucgacuccugggugaaccaguucuacacccuggcccccauggggaacggcacgggccggcgccgcuga

SEQ ID NO: 12038 - RNA, 1617 nt, Artificial Sequence
  derived and/or modified sequence opt1 from VP1__Norovirus_and/or_Norovirus-like__KM198568
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcggggucacccacaucgccggcagccgcaacuacaccaugaaccuggccucccugaacuggaacaacuacgaccccaccgaggagaucccggcgccccucgggacgcccgacuucgugggcaagauccagggggugcugacccagaccaccaagggcgacggcagcacgcgggggcacaaggccaccgucuacaccggcuccgcccccuucaccccgaagcuggggagcgugcaguucagcacggacaccgagaacgacuucgaggcccaccagaacaccaaguucacccccgugggcgucauccaggacgggggcacgacccaccgcaacgagccccagcagugggugcuccccuccuacagcggccgggacgugcacaacguccaccuggccccggcgguggcccccaccuuccccggggagcagcuccucuucuuccgcuccaccaugcccggcugcagcggguacccgaacauggaccuggacugccugcucccccaggagugggugcagcacuucuaccaggaggccgcccccgcgcaguccgacgucgcccugcugcgguucgugaaccccgacacgggccgcguccucuucgagugcaagcugcacaagagcggguacgugaccguggcccacaccggccagcacgaccuggugaucccgcccaacggcuacuuccgguucgacuccugggucaaccaguucuacacccucgcccccauggggaacggcaccgggcgccggcgcuga

SEQ ID NO: 12039 - RNA, 1617 nt, Artificial Sequence
  derived and/or modified sequence opt1 from VP1__Norovirus_and/or_Norovirus-like__KM198532
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccgugccccuggagaagcuguucacgggccccagcggggccuucgucgugcagccgcagaacggccgcugcaccaccgacgggguccugcugggcaccacgcagcucucccccgugaacaucugcaccuuccggggcgacgugacccacaucgccgggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgagacccaccagaacacgaaguucacccccgugggggugauccaggacggcgggaccacccaccgcaacgagccccagcaguggguccuccccuccuacagcggccgggacgugcacaacgugcaccuggccccggccgucgcgcccacguuccccggcgagcagcuccucuucuuccgcuccaccaugcccgggugcagcggcuacccgaacauggaccuggacugccugcucccccaggagugggugcagcacuucuaccaggaggccgcccccgcccaguccgacguggcgcugcugcgguucgucaaccccgacaccgggcgcguccucuucgagugcaagcugcacaagagcggcuacgugaccguggcccacaccgggcagcacgaccuggugaucccgcccaacggcuacuuccgguucgacuccugggugaaccaguucuacacgcucgcccccaugggcaacgggaccggccgccggcgcuga

SEQ ID NO: 12040 - RNA, 1617 nt, Artificial Sequence
  derived and/or modified sequence opt1 from VP1__Norovirus_and/or_Norovirus-like__KM198527
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcgggacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcuga

SEQ ID NO: 12041 - RNA, 1617 nt, Artificial Sequence
  derived and/or modified sequence opt1 from VP1__Norovirus_and/or_Norovirus-like__KF177448
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccagcgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacacccacaacguccaccucgccccggcgguggcccccaccuuccccggcgagcagcugcuguucuuccgcuccacgaugcccgggugcagcggcuacccgaacauggaccucgacugccugcugccccaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 12042 - RNA, 1617 nt, Artificial Sequence
  derived and/or modified sequence opt1 from VP1__Norovirus_and/or_Norovirus-like__KF008244
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgagaccaaccagaacaccaaguucacgcccgucggggugauccaggacggcuccaccacccaccgcaacgagccccagcagugggugcugcccagcuacuccgggcggaacacccacaacguccaccucgccccggccguggcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 12043 - RNA, 1617 nt, Artificial Sequence
  derived and/or modified sequence opt1 from VP1__Norovirus_and/or_Norovirus-like__KF060103
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccacaacuacaccaugaaccuggccagccagaacuggaacagcuacgacccgaccgaggagauccccgcgccccuggggacgcccgacuucgucggcaagauccagggggugcucacccagaccacccgcacggacggcuccacccgggggcacaaggccaccguguacaccggcagcgccgacuucuccccgaagcugggccgcguccaguucgccacggacaccgacaacgacuucgagaccaaccagaacaccaaguucacgcccgugggggugauccaggacggcgggaccacccaccggaacgagccccagcaguggguccugcccagcuacuccggccgcaacauccacaacgugcaccucgccccggccguggcccccaccuuccccggggagcagcugcuguucuuccggagcacgaugcccggcugcuccggcuacccgaacauggaccucgacugccugcugccccaggaguggguccaguacuucuaccaggaggcggcccccgcccagagcgacguggcccuccugcgcuucgugaaccccgacaccgggcggguccuguucgagugcaagcuccacaaguccggcuacgugaccguggcgcacaccgggcagcacgaccuggucaucccgcccaacggcuacuuccgcuucgacagcugggugaaccaguucuacacccuggcccccauggggaacggcacgggccggcgccgcuga

SEQ ID NO: 12044 - RNA, 1617 nt, Artificial Sequence
  derived and/or modified sequence opt1 from VP1__Norovirus_and/or_Norovirus-like__KC960615
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcuccgccuucgugguccagccgcagaacgggcggugcaccaccgacggcgugcugcuggggaccacgcagcucagccccgucaacaucugcaccuuccgcggcgacgugacccacaucgccggcucccggaacuacaccaugaaccuggccagccugaacuggaacaacuacgaccccacggaggagaucccggcgccccucgggacccccgacuucgugggcaagauccaggggguccugacccagaccacgaagggcgacggguccacccgcggccacaaggccaccguguacaccggcagcgcccccuucacgccgaagcuggggagcgugcaguucuccaccgacaccgagaacgacuucgagauccaccagaacaccaaguucacgcccgucggcgugauccaggacgggggcaccacccaccggaacgagccccagcagugggugcuccccagcuacuccgggcgcgacguccacaacgugcaccuggccccggccguggcgcccaccuuccccggcgagcagcuccucuucuuccggagcacgaugcccggcugcuccggguacccgaacauggaccuggacugccugcucccccaggaguggguccagcacuucuaccaggaggccgcccccgcccagagcgacguggcgcugcugcgcuucgugaaccccgacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcuga

SEQ ID NO: 12045 - RNA, 1617 nt, Artificial Sequence
  derived and/or modified sequence opt1 from VP1__Norovirus_and/or_Norovirus-like__KC517373
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacuccggcuuccccaucccccuggagaagcuguucaccgggcccagcuccgccuucgugguccagccgcagaacggccggugcacgaccgacggggugcugcugggcaccacccagcucagccccgucaacaucugcacguuccgcggcgacgugacccacaucgccgggucccggaacuacaccaugaaccuggccagccugaacuggaacaacuacgaccccaccgaggagaucccggcgccccucggcacgcccgacuucguggggaagguccagggcgugcugacccagaccaccaagggggacggcuccacgcgcggccacaaggccaccguguacaccgggagcgcccccuucaccccgaagcugggcagcguccaguucgagacggacaccgagaacgacuucgagacccaccagaacaccaaguucacgcccgugggggugauccaggacggcgggaccgcccaccggaacgagccccagcaguggguccuccccuccuacagcggccgcaacgugccgaacgugcaccuggcccccgcggucgcccccaccuuccccggcgagcagcuccucuucuuccgguccaccaugccggggugcagcggcuaccccaacauggaccuggacugccugcucccccaggagugggugcagcacuucuaccaggaggccgcccccgcgcaguccgacguggcccugcugcgcuucgucaacccggacacggggcggguccucuucgagugcaagcugcacaagagcggcuacgugaccguggcccacaccgggcagcgcgaccuggugaucccgcccaacggcuacuuccgguucgacuccugggugaaccaguucuacacccucgcccccaugggcaacgggaccggccgccggcgcuga

SEQ ID NO: 12046 - RNA, 1617 nt, Artificial Sequence
  derived and/or modified sequence opt1 from VP1__Norovirus_and/or_Norovirus-like__JX459615
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggaguucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 12047 - RNA, 1617 nt, Artificial Sequence
  derived and/or modified sequence opt1 from VP1__Norovirus_and/or_Norovirus-like__JX459603
augaagauggccagcaacgacgccacccccuccgacggcguggcggcccaccuggucccggaggugaacaacgaggugauggcccucgagcccgucgugggggccgccaucgcggcccccguggccggccagcagaacgucaucgaccccuggauccgcaacaacuucgugcaggcccccgggggcgaguucaccgugagcccccggaacgcgcccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgaggacguguucaccgucuccugccgcgugcugacccggcccagcccggacuucgacuucaucuuccucgugccgcccaccgucgagucccgcacgaagcccuucaccgugcccauccugaccguggaggagaugaccaacagccgguuccccaucccccuggagaagcuguucacgggccccuccggggccuucgucgugcagccgcagaacggccgcugcaccaccgacgggguccugcugggcaccacgcagcucagccccgugaacaucugcaccuuccggggcgacgugacccacaucgccgggucccgcaacuacaccaugaaccuggccagccugaacuggaacaacuacgaccccacggaggagaucccggcgccccucggcacccccgacuucgucgggaagauccagggcgugcugacccagaccacgaagggggacggcuccacccggggccacaaggccaccguguacaccgggagcgcccccuucacgccgaagcugggcuccguccaguucagcaccgacaccgagaacgacuucgagacccaccagaacacgaaguucacccccgugggggugauccaggacggcgggaccacccaccgcaacgagccccagcaguggguccuccccagcuacuccggccggaacgugcacaacgugcaccuggccccggccgucgcgcccacguuccccggcgagcagcuccucuucuuccgcagcaccaugcccgggugcuccggcuacccgaacauggaccuggacugccugcucccccaggagugggugcagcacuucuaccaggaggccgcccccgcccagagcgacguggcgcugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacgcucgcccccaugggcaacgggaccggccgccggcgcuga

SEQ ID NO: 12048 - RNA, 1617 nt, Artificial Sequence
  derived and/or modified sequence opt1 from VP1__Norovirus_and/or_Norovirus-like__JX155746
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagcccggcuacgugaccguggcccacaccgggcagcacgaccuggugaucccgcccaacggcuacuuccgguucgacagcugggucaaccaguucuacacccucgcccccauggggaacggcacgggccgccggcgcuga

SEQ ID NO: 12049 - RNA, 1617 nt, Artificial Sequence
  derived and/or modified sequence opt1 from VP1__Norovirus_and/or_Norovirus-like__AB541333
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccuggacccggaccucaaccccuaccugucccagcuggcccgcauguacaacggcuacgccggcggguucgaggugcaggucauccucgccggcaacgccuucaccgccgggaagaucaucuucgccgccgugccgcccaacuucccgacggagggccugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggggaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacggccgcugcacgaccgacggggugcugcugggcaccacccagcucagccccgucaacaucugcacguuccgcggggacgugacccacaucgccggcucccggaacuacaccaugaaccuggccagccugaacuggaacaacuacgaccccaccgaggagaucccggcgccccucggcacgcccgacuucguggggaagauccagggcguccugacccagaccaccaagggggacggcuccacgcgggggcacaaggccaccguguacaccggcagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggggagcagcuccucuucuuccgcagcacgaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 12050 - RNA, 1617 nt, Artificial Sequence
  derived and/or modified sequence opt1 from VP1__Norovirus_and/or_Norovirus-like__AB541220
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcuguacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 12051 - RNA, 1617 nt, Artificial Sequence
  derived and/or modified sequence opt1 from VP1__Norovirus_and/or_Norovirus-like__AB504312
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgacccgccgggacggcuccacccgcgggcacaaggccaccgugagcacgggcagcgugcacuucacccccaagcugggcuccguccaguucagcaccgacaccuccaacgacuucgagacggggcagaacacccgguucaccccggugggcgugguccaggacgggagcaccacgcaccagaacgagccccagcagugggugcugcccaacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcgagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcuga

SEQ ID NO: 12052 - RNA, 1617 nt, Artificial Sequence
  derived and/or modified sequence opt1 from VP1__Norovirus_and/or_Norovirus-like__GQ849126
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucgucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggggacgacguguucaccgucuccugccgcgugcugacccggccgagccccgacuucgacuucaucuuccucgugccgcccaccgucgagucccgcacgaagcccuucagcgugcccauccugaccguggaggagaugaccaacucccgguuccccaucccccuggagaagcuguucaccggcccgagcuccgccuucgucgugcagccccagaacggccgcugcacgaccgacgggguccuccugggcaccacccagcucagccccgugaacaucugcacguuccgggggaacgugacccacaucgccggcacccaggaguacaccaugaaccuggccucccagaacuggaacaacuacgacccgacggaggagauccccgcgccccugggcacccccgacuucgucgggaagauccagggcgugcucacccagaccacgcgccgggacgggagcacccgcggccacaaggccaccgugagcaccggguccguccacuucacgccgaagcugggccggauccaguucagcaccgacaccuccaacgacuucgagaccggccagaacacgcgcuucacccccgugggggugguccaggacggcagcaccacccaccagaacgagccccagcagugggugcugcccaacuacuccgggcgggacagccacaacgugcaccucgccccggccgucgcccccuccuuccccggcgagcagcugcuguucuuccgcagcacgaugcccgggugcuccggcuacccgaacaugaaccucgacugccugcugccccaggagugggugcagcacuucuaccaggaggccgcgcccgcccagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcgcccaugggcaacgggacgggccgccgccgguga

SEQ ID NO: 12053 - RNA, 1617 nt, Artificial Sequence
  derived and/or modified sequence opt1 from VP1__Norovirus_and/or_Norovirus-like__AB447459
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggccugcugacccagaccaccaagggggacggcagcacgcggggccacaaggccaccgucuacaccggguccgcccccuucaccccgaagcucggcagcgugcaguucagcacggacaccgagaacgacuucgagacccaccagaacaccaaguucacgcccgugggggucauccaggacggcuccaccacccaccgcaacgagccccagcagugggugcugcccagcuacuccgggcggaacgugcacaacguccaccuggccccggccguggcgcccaccuuccccggcgagcagcucaucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 12054 - RNA, 1617 nt, Artificial Sequence
  derived and/or modified sequence opt1 from VP1__Norovirus_and/or_Norovirus-like__EU078413
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcuccugggcaccacgcagcucucccccgucaacaucugcaccuuccggggcgacgugacccacaucgccgggacccgcaacuacacgaugaaccuggccagccagaacuggaacaacuacgaccccaccgaggagaucccggcgccccugggcacccccgacuucguggggcggauccagggcaugcucacccagacgacccgccgggacggguccacccgcggccacaaggccaccgucagcacgggcgacgcccacuucacccccaagcugggguccaucauguucagcaccgacaccgacaacgacuucgagacgggccagaacaccaaguucaccccggugggggugguccaggacggcaacgggacccaccagaacgagccccagcagugggugcugcccagcuacuccggccggacgggccacaacgugcaccucgcccccgccgucgccccgaccuuccccggggagcagcugcuguucuuccgcagcaccaugcccggcugcuccggguaccccaacaugaaccucgacugccugcugccgcaggagugggugcagcacuucuaccaggaggcggcccccgcccagagcgacguggcccuccugcgguucgucaaccccgacaccggccgcgugcuguucgagugcaagcuccacaaguccggguacgugaccgucgcgcacacgggccagcacgaccuggugaucccgcccaacggcuacuuccgguucgacagcugggugaaccaguucuacacccuggcccccauggggaacggcaccgggcgccgccgguga

SEQ ID NO: 12055 - RNA, 1617 nt, Artificial Sequence
  derived and/or modified sequence opt1 from VP1__Norovirus_and/or_Norovirus-like__EU078411
augaagauggccagcaacgacgccucccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucccgggcacccgcacguaccggaugaaccuggccucccagaacuggaacaacuacgaccccaccgaggagauccccgcgccccuggggaccccggacuucgugggcaagauccaggggaugcucacccagacgaccaagggcgacgggagcacccgcggccacaaggccaccgucuccacgggcagcguggacuucacccccaagcuggggagcgugcaguucgccaccgacaccgacaacgacuucgagacgggccagaacacccgguucacccccgucggggugauccaggacggcuccagcgcccaccgcaacgagccccagcagugggugcugccggacuacuccgggcggaccguccacaacgugcaccucgcccccgccguggcccccacguuccccggcgagcagcugcuguucuuccgcagcaccaugccgggcugcuccggguaccccaacauggaccucgacugccugcugccccaggaguggguccagcacuucuaccaggaggcggcccccgcccagagcgacguggcccuccugcgguucgugaacccggacaccggccgcguccuguucgagugcaagcuccacaagaccggguacgugaccguggcgcacacgggccagcacgaccuggucaucccgcccaacggguacuuccgguucgacuccugggugaaccaguucuacacccuggcccccaugggcaacggcgccgggcgccgccgguga

SEQ ID NO: 12056 - RNA, 1617 nt, Artificial Sequence
  derived and/or modified sequence opt1 from VP1__Norovirus_and/or_Norovirus-like__AB385632
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucguguucgccgccgugccgcccaacuucccgaccgagggccugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggggacgacguguucaccgucuccugccgcgugcugacccggccgagccccgacuucgacuucaucuuccucgugccgcccaccgucgagucccgcacgaagcccuucagcgugcccauccugaccguggaggagaugaccaacucccgguuccccaucccccuggagcgccucuucaccggcccgagcuccgccuucgucgugcagccccagaacggccggugcacgaccgacgggguccugcugggcaccacccagcucagccccgugaacaucugcacguuccgcggggacgugacccacaucgccggcacccaggaguacaccaugaaccuggccucccagaacuggaacaacuacgacccgacggaggagguccccgcgccccugggcacccccgacuucauggggaagauccagggcgugcucacccagaccacgcggcgcgacgggagcacccggggccacaaggccaccgugagcaccggguccguccacuucacgccgaagcugggccgcauccaguucagcaccgacaccuccaacgacuucgagaccggccagaacacgcgguucacccccgugggggugguccaggacggcagcaccacccaccagaacgagccccagcagugggugcugcccaacuacuccgggcgcgacagccacaacgugcaccucgccccggccgucgcccccuccuuccccggcgagcagcugcuguucuuccggagcacgaugcccgggugcuccggcuacccgaacaugaaccucgacugccugcugccccaggagugggugcagcacuucuaccaggaggccgcgcccgcccagagcgacguggcccuccugcgcuucgucucccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcgcccaugggcaacgggacgggccgccggcgcuga

SEQ ID NO: 12057 - RNA, 1617 nt, Artificial Sequence
  derived and/or modified sequence opt1 from VP1__Norovirus_and/or_Norovirus-like__EU839595
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccgggcuucgacuucaucuuccucgugccgcccaccguggagagccgcaccaagcccuucacgguccccauccugaccguggaggagaugaccaacucccgguuccccaucccccuggagaagcuguucaccgggcccagcuccgccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggcgagcagcuccucuucuuccgcagcacgaugccggggugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 12058 - RNA, 1617 nt, Artificial Sequence
  derived and/or modified sequence opt1 from VP1__Norovirus_and/or_Norovirus-like__AB294788
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgaccacccgcgacggcuccacccgggggcacaaggccacggugagcaccggcagcgugcacuucacccccaagcugggcuccguccaguucagcaccgacacguccaacgacuucgagaccgggcagaacacccgcuucaccccggugggcgugguccaggacgggagcacgacccaccagaacgagccccagcagugggugcugcccgacuacuccggccgggacagccacaacgugcaccucgcccccgccgucgccccgaccuuccccggggagcagcugcuguucuuccgcuccaccaugcccggcugcagcggcuaccccaacaugaaccucgacugccugcugccgcaggagugggugcagcacuucuaccaggaguccgcccccgcgcagagcgacguggcccuccugcgguucgucaaccccgacaccgggcgcgugcuguucgagugcaagcuccacaaguccggcuacgugacggucgcccacaccgggcagcacgaccuggugaucccgcccaacggcuacuuccgguucgacagcugggugaaccaguucuacacccuggcccccauggggaacggcgcgggccgccggcgcuga

SEQ ID NO: 12059 - RNA, 1617 nt, Artificial Sequence
  derived and/or modified sequence opt1 from VP1__Norovirus_and/or_Norovirus-like__AB303936
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccagcuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcaccaagcccuucaccguccccauccugaccguggaggagaugacgaacucccgguuccccaucccccuggagaagcuguucaccggcccgagcggggccuucgugguccagccccagaacggccgcugcaccaccgacggggugcuccugggcacgacccagcucucccccgucaacaucugcaccuuccggggcgacgugacccacaucgccgggacgcacaacuacaccaugaaccuggccagccagaacuggaacaacuacgacccgaccgaggagauccccgcgccccugggcacccccgacuucguggggcgcauccagggcaugcucacgcagaccacccgcggggacggcuccacccggggccacaaggccacggucagcaccggggacgugcacuucaccccgaagcugggcuccgugcaguucgacaccgacacgaacagcgacuucgagaccgggcagaacaccaaguucacccccgucggcguggugcaggacgggaacggcgcccaccagaacgagccccagcaguggguccugcccagcuacuccggccggacggggcacaacgcccaccucgccccggccguggcgcccaccuuccccggcgagcagcugcuguucuuccgcagcaccaugcccgggugcuccggcuacccgaacaugaaccucgacugccugcugccccaggagugggugcagcacuucuaccaggaggccgcccccgcccagagcgacgucgcgcuccugcgguucgugaaccccgacaccgggcgcgugcuguucgagugcaagcuccacaaguccggcuacgucaccguggcccacacgggccagcacgaccuggugaucccgcccaacggguacuuccgguucgacagcugggucaaccaguucuacacccuggcccccaugggcaacgggaccggccgccggcgcuga

SEQ ID NO: 12060 - RNA, 1617 nt, Artificial Sequence
  derived and/or modified sequence opt1 from VP1__Norovirus_and/or_Norovirus-like__AB303935
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccagcuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggggccuucgugguccagccccagaacggccgcugcaccaccgacggggugcuccugggcaccacgcagcucucccccgucaacaucugcaccuuccggggcgacgugacccacaucgccgggacccacaacuacacgaugaaccuggccagccagaacuggaacaacuacgacccgaccgaggagauccccgcgccccugggcacccccgacuucguggggcgcauccagggcaugcucacccagacgacccgcggggacggcuccacccggggccacaaggccaccgucagcacgggggacgugcacuucaccccgaagcugggcuccauccaguucaacaccgacaccaacaacgacuucgagacggggcagaacaccaaguucacccccgugggcgucgugcaggacgggaacggcacccaccagaacgagccccagcagugggugcugcccagcuacagcggccggacggggcacaacguccaccucgccccggccguggcccccaccuuccccggcgagcagcugcuguucuuccgcuccaccaugcccgggugcagcggcuacccgaacaugaaccucgacugccugcugccccaggagugggugcagcacuucuaccaggaggccgcgcccgcccaguccgacgucgcccuccugcgguucgugaaccccgacaccgggcgcgugcuguucgagugcaagcuccacaagagcggcuacgucaccguggcccacacgggccagcacgaccuggugaucccgcccaacggguacuuccgguucgacuccugggucaaccaguucuacacccuggcgcccaugggcaacgggaccggccgccggcgcuga

SEQ ID NO: 12061 - RNA, 1617 nt, Artificial Sequence
  derived and/or modified sequence opt1 from VP1__Norovirus_and/or_Norovirus-like__AY588018
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcgugcaguucaacaccgacaccaacaacgacuucgagacggggcagaacaccaaguucacccccgucggcguggugcaggacgggaacggcgcccaccagaacgagccccagcaguggguccugcccuccuacagcggccggaccgggcacaacgugcaccucgccccggccguggcccccacguuccccggcgagcagcugcuguucuuccgcagcaccaugcccgggugcuccggcuacccgaacaugaaccucgacugccugcugccccaggaguggguccagcacuucuaccaggaggcggcccccgcccagagcgacguggcccuccugcgguucgugaaccccgacaccgggcgcguccuguucgagugcaagcuccacaaguccggcuacgugaccguggcgcacaccggccagcacgaccuggucaucccgcccaacggguacuuccgguucgacagcugggugaaccaguucuacacgcuggcccccaugggcaacgggaccggccgccggcgcuga

SEQ ID NO: 12062 - RNA, 1617 nt, Artificial Sequence
  derived and/or modified sequence opt1 from VP1__Norovirus_and/or_Norovirus-like__KU678203
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcuga

SEQ ID NO: 12063 - RNA, 1617 nt, Artificial Sequence
  derived and/or modified sequence opt1 from VP1__Norovirus_and/or_Norovirus-like__KP176410
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacaccgaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccgccggcgcuga

SEQ ID NO: 12064 - RNA, 1617 nt, Artificial Sequence
  derived and/or modified sequence opt1 from VP1__Norovirus_and/or_Norovirus-like__KX371609
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccacccggggcgacggguccacgcgcggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccggaacgagccccagcagugggugcuccccuccuacagcgggcgcaacgugccgaacguccaccuggcccccgccguggcgcccaccuuccccggcgagcagcuccucuucuuccgguccacgaugccgggcugcagcggguaccccaacauggaccuggacugccugcucccccaggagugggugcagcacuucuaccaggaggccgcccccgcccaguccgacgucgcgcugcugcgcuucgugaacccggacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacggcacggggcggcgccgcuga

SEQ ID NO: 12065 - RNA, 1617 nt, Artificial Sequence
  derived and/or modified sequence opt1 from VP1__Norovirus_and/or_Norovirus-like__KX354130
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagcgccucuucaccggcccguccagcgccuucgucgugcagccccagaacgggcggugcaccacggacggcgugcugcuggggaccacccagcucucccccgucaacaucugcaccuuccgcggcgacaucacgcacaucaccggcagccacaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgaguucgccccgaagcugggccgggugcaguucgagacggacaccaaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacaucaccguggcccacaccggccagcacgaccuggucaucccgcccaacggguacuuccgguucgacagcugggugaaccaguucuacacccuggcccccaugggcaacgggacgggccgcaagcgcuga

SEQ ID NO: 12066 - RNA, 1617 nt, Artificial Sequence
  derived and/or modified sequence opt1 from VP1__Norovirus_and/or_Norovirus-like__KX354120
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggugaaccagaacaccaaguucacccccgucggggugauccaggacggcagcacgacccaccgcaacgagccccagcagugggugcugcccuccuacagcgggcggaacaccccgaacguccaccucgcccccgccguggcgcccaccuuccccggcgagcagcugcuguucuuccgcuccacgaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 12067 - RNA, 1617 nt, Artificial Sequence
  derived and/or modified sequence opt1 from VP1__Norovirus_and/or_Norovirus-like__KX354113
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagcgccucuucaccggcccgagcuccgccuucgucgugcagccccagaacgggcggugcaccacggacggcgugcugcuggggaccacccagcucagccccgucaacaucugcaccuuccgcggcgacgugacgcacaucaccggcucccggaacuacaccaugaaccuggccagccagaacuggagcaacuacgacccgaccgaggagauccccgcgccccuggggacgcccgacuucgugggcaagauccaggggguccucacccagaccacccgcacggacggcuccacccgggggcacaaggccaccguguacaccggcagcgccgacuucgccccgaagcugggccgcgugcaguucgagacggacaccgaccacgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcuga

SEQ ID NO: 12068 - RNA, 1617 nt, Artificial Sequence
  derived and/or modified sequence opt1 from VP1__Norovirus_and/or_Norovirus-like__KX354105
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccgccggcgcuga

SEQ ID NO: 12069 - RNA, 1617 nt, Artificial Sequence
  derived and/or modified sequence opt1 from VP1__Norovirus_and/or_Norovirus-like__KX354077
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccacccggggcgacggguccacgcgcggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccggaacgagccccagcagugggugcuccccuccuacagcgggcgcuccgugccgaacguccaccuggcccccgccguggcgcccaccuuccccggcgagcagcuccucuucuuccggagcacgaugccgggcugcuccggguaccccaacauggaccuggacugccugcucccccaggagugggugcagcacuucuaccaggaggccgcccccgcccagagcgacgucgcgcugcugcgcuucgugaacccggacaccggccggguccucuucgagugcaagcugcacaaguccggguacgugaccguggcccacaccggccagcacgaccuggugaucccgcccaacggguacuuccgcuucgacagcugggucaaccaguucuacacccucgcccccaugggcaacggcacggggcggcgccgcuga

SEQ ID NO: 12070 - RNA, 1617 nt, Artificial Sequence
  derived and/or modified sequence opt1 from VP1__Norovirus_and/or_Norovirus-like__KR131785
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccaaccacgacuucgaggccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcuga

SEQ ID NO: 12071 - RNA, 1617 nt, Artificial Sequence
  derived and/or modified sequence opt1 from VP1__Norovirus_and/or_Norovirus-like__AB972530
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 12072 - RNA, 1617 nt, Artificial Sequence
  derived and/or modified sequence opt1 from VP1__Norovirus_and/or_Norovirus-like__AB972526
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccgaccacgacuucgaggccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcuga

SEQ ID NO: 12073 - RNA, 1617 nt, Artificial Sequence
  derived and/or modified sequence opt1 from VP1__Norovirus_and/or_Norovirus-like__AB972522
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccaacuucgccccgaagcugggccggauccaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 12074 - RNA, 1617 nt, Artificial Sequence
  derived and/or modified sequence opt1 from VP1__Norovirus_and/or_Norovirus-like__AB972514
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgccguggcgcccaccuuccccggcgagcagcuccucuucuuccgcuccaucaugccgggcugcagcggguaccccaacauggaccuggacugccugcucccccaggagugggugcagcacuucuaccaggaggccgcccccgcccaguccgacgucgcgcugcugcgguucgugaacccggacacgggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcaccgggcgccggcgcuga

SEQ ID NO: 12075 - RNA, 1617 nt, Artificial Sequence
  derived and/or modified sequence opt1 from VP1__Norovirus_and/or_Norovirus-like__AB972505
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacggcccaccgcaacgagccccagcagugggugcugcccuccuacagcgggcggaacaccccgaacguccaccucgcgcccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 12076 - RNA, 1617 nt, Artificial Sequence
  derived and/or modified sequence opt1 from VP1__Norovirus_and/or_Norovirus-like__AB972473
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcuccacgacccaccggaacgagccccagcagugggugcugcccagcuacuccgggcgcaacacccacaacguccaccucgccccggcgguggcccccaccuuccccggcgagcagcugcuguucuuccggagcacgaugcccgggugcuccggcuacccgaacauggaccucgacugccugcugccccaggagugggugcaguacuucuaccaggaggccgcccccgcgcagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccgccggcgcuga

SEQ ID NO: 12077 - RNA, 1617 nt, Artificial Sequence
  derived and/or modified sequence opt1 from VP1__Norovirus_and/or_Norovirus-like__KT780381
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggacauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12078 - RNA, 1617 nt, Artificial Sequence
  derived and/or modified sequence opt1 from VP1__Norovirus_and/or_Norovirus-like__KT780372
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagguccuccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccgcaacuacaccaugaaccuggccucccagaacuggagcaacuacgacccgaccgaggagauccccgcgccccucgggacgcccgacuucgugggcaagauccaggggguccugacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcuccccuccuacagcgggcggaacaccccgaacguccaccuggcccccgcgguggcccccaccuuccccggcgagcagcuccuguucuuccgcuccacgaugccggggugcagcggcuaccccaacauggaccuggacugccugcucccccaggagugggugcaguacuucuaccaggaggccgcccccgcgcaguccgacgucgcccugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacgggacgggccgccgccgguga

SEQ ID NO: 12079 - RNA, 1617 nt, Artificial Sequence
  derived and/or modified sequence opt1 from VP1__Norovirus_and/or_Norovirus-like__KT202797
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccgaccgggacuucgaggccaaccagaacaccaaguucacccccgucggggugauccaggacggcgggacgacccaccgcaacgagccccagcagugggugcugcccagcuacuccggccggagcaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12080 - RNA, 1617 nt, Artificial Sequence
  derived and/or modified sequence opt1 from VP1__Norovirus_and/or_Norovirus-like__KR904226
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgacccgaccgaggagauccccgcgccccuggggacgcccgacuucgucggcaagauccaggggaugcucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggagcgcccacaacguccaccucgcgccggccguggcccccaccuuccccggcgagcagcugcuguucuuccgcuccaccaugcccgggugcagcggcuacccgaacauggaccucgacugccugcugccccaggagugggugcaguacuucuaccaggaggccgcgcccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 12081 - RNA, 1617 nt, Artificial Sequence
  derived and/or modified sequence opt1 from VP1__Norovirus_and/or_Norovirus-like__KR904208
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucguguucuccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgacgacguguucaccgucuccugccgcgugcugacccggccgagccccgacuucgacuucaucuuccucgugccgcccaccgucgagucccgcaccaagcccuucagcgugcccauccugacgguggaggagaugaccaacucccgguuccccaucccccuggagaagcuguucaccggcccgagcuccaccuucgucgugcagccccagaacgggcgcugcacgaccgacggcguccuccuggggaccacccagcucagccccgugaacaucugcacguuccggggcgacgugacccacaucgccggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgacgccaaccagaacaccaaguucacccccgugggggugauccaggacggcaacacggcccaccgcaacgagccccagcaguggguccugcccagcuacuccgggcggaacacccacaacgugcaccucgccccggcgguggcccccaccuuccccggcgagcagcugcuguucuuccgcagcaccaugcccgggugcuccggcuacccgaacauggaccucgacugccugcugccccaggaguggguccaguacuucuaccaggaggccgcccccgcgcagagcgacguggcccuccugcgguucgugaaccccgacacgggccgcguccuguucgagugcaagcuccacaaguccggguacgugaccguggcccacaccggccagcacgaccuggucaucccgcccaacggguacuuccgguucgacagcugggugaaccacuucuacacccuggcccccgugggcaacgggaccggccgccgccgguga

SEQ ID NO: 12082 - RNA, 1617 nt, Artificial Sequence
  derived and/or modified sequence opt1 from VP1__Norovirus_and/or_Norovirus-like__AB933709
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcgcccccuucaccccgaagcugggguccgugcaguucagcacggacaccgagaacgacuucgagacccaccagaacaccaaguucacgcccgugggcgucauccacgacggguccaccacccaccgcaacgagccccagcagugggugcuccccagcuacuccggccggaacgugccgaacguccaccuggcccccgccguggcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacgucgcgcugcugcgguucgugaacccggacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcuga

SEQ ID NO: 12083 - RNA, 1617 nt, Artificial Sequence
  derived and/or modified sequence opt1 from VP1__Norovirus_and/or_Norovirus-like__EU921352
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagcgccucuucaccggccccagcuccgccuucgugguccagccgcagaacgggcggugcacgaccgacggcgugcugcuggggaccacccagcucagccccgucaacaucugcacguuccgcggcgacgugacccacaucgccggcacccaggaguacaccaugaaccuggccucccagaacuggaacaacuacgaccccacggaggagaucccggcgccccuggggacccccgacuucgugggcaagauccaggggguccucacccagaccacgcggcgcgacggcagcacccgggggcacaaggccaccgugagcaccggcuccgugcacuucacgcccaagcugggccgcauccaguucagcaccgacaccuccaacgacuucgagaccgggcagaacacgcgguucaccccggucggcguggugcaggacgggggcaccacccaccagaacgagccccagcaguggguccugcccgacuacagcgggcgcgacggccacaacgugcaccucgcccccgccguggccccguccuuccccggcgagcagcugcuguucuuccggagcacgaugcccgggugcuccggcuaccccaacaugaaccucgacugccugcugccgcaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccaugggcaacgggacgggccgccggcgcuga

SEQ ID NO: 12084 - RNA, 1617 nt, Artificial Sequence
  derived and/or modified sequence opt1 from VP1__Norovirus_and/or_Norovirus-like__LC005735
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12085 - RNA, 1617 nt, Artificial Sequence
  derived and/or modified sequence opt1 from VP1__Norovirus_and/or_Norovirus-like__KP241909
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgagaccaaccagaacaccaaguucacgcccgucggggugauccaggacggcgggaccacccaccgcaacgagccccagcagugggugcugcccagcuacuccggccggaacaccccgaacguccaccucgcccccgccguggcgcccacguuccccggggagcagcugcuguucuuccgcagcaccaugccgggcugcuccggcuaccccaacaccgaccucgacugccugcugccccaggagugggugcaguacuucuaccaggaggccgcccccgcccagagcgacgucgcgcuccugcgguucgugaacccggacaccgggcgcgugcuguucgagugcaagcuccacaaguccggcuacgucaccguggcccacacggggcagcacgaccuggugaucccgcccaacggcuacuuccgguucgacagcugggucaaccaguucuacacccuggcccccauggggaacggcaccggccgccgccgguga

SEQ ID NO: 12086 - RNA, 1617 nt, Artificial Sequence
  derived and/or modified sequence opt1 from VP1__Norovirus_and/or_Norovirus-like__KJ533132
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcaguacgaccuggugaucccgcccaacggcuacuuccgguucgacuccugggucaaccaguucuacacccuggcccccauggggaacggcacgggccgccgccgguga

SEQ ID NO: 12087 - RNA, 1617 nt, Artificial Sequence
  derived and/or modified sequence opt1 from VP1__Norovirus_and/or_Norovirus-like__KP176407
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggagcucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaaccgcgaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgguga

SEQ ID NO: 12088 - RNA, 1617 nt, Artificial Sequence
  derived and/or modified sequence opt1 from VP1__Norovirus_and/or_Norovirus-like__KP176406
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggauccccgacuucgugggcaagauccaggggaugcucacgcagaccacccggaccgacggcagcacgcgcgggcacaaggccaccguguacaccggcuccgccgacuucgccccgaagcugggccggguccaguucgagaccgacacggaccacgacuucgaggccaaccagaacaccaaguucacccccgugggggugauccaggacggcagcaccacgcaccgcaacgagccccagcaguggguccugcccuccuacagcgggcggaacaccccgaacgugcaccucgcccccgcgguggcccccaccuuccccggcgagcagcugcuguucuuccgcuccaccaugccggggugcagcggcuaccccaacauggaccucgacugccugcugccccaggaguggguccaguacuucuaccaggaggccgcccccgcgcaguccgacguggcccuccugcgguucgugaacccggacacgggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggaccggccgccgccgguga

SEQ ID NO: 12089 - RNA, 1617 nt, Artificial Sequence
  derived and/or modified sequence opt1 from VP1__Norovirus_and/or_Norovirus-like__KP123606
augaagauggccagcuccgacgccaaccccagcgacggcuccgcggccaaccuggugcccgaggucaacaacgaggugauggcccucgagcccguggucggggccaccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaaggugaucuucgccgccgugccgcccaacuucccgaccgaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggccaacaacgcgggcgacgacgucuucaccgugagcugccgcgugcugacccggccgucccccgacuucgacuucaucuuccucgucccgcccaccguggagagccgcacgaagcccuucuccgugcccauccugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucaccggcagccgcaacuacaccaugaaccuggccucccagaacuggagcaacuacgacccgacggaggagauccccgcgccccuggggauccccgacuucgugggcaagauccaggggaugcucacccagaccacccggacggacggcagcacccgcgggcacaaggccaccguguacaccggcuccgccgacuucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgccguggcgcccaccuuccccggcgagcagcugcuguucuuccgcuccacgaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12090 - RNA, 1617 nt, Artificial Sequence
  derived and/or modified sequence opt1 from VP1__Norovirus_and/or_Norovirus-like__KP096335
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccugaccucccagaacuggagcaacuacgacccgacggaggagauccccgcgccccuggggacccccgacuucgugggcaagauccaggggaugcucacccagaccacgcggaccgacggcagcacccgcgggcacaaggccaccgucuacacgggcuccgccgacuucgccccgaagcugggccgggugcaguucgagaccgacaccgaccacgacuucgaggccaaccagaacaccaaguucacgcccgugggggucauccaggacggcagcaccacccaccgcaacgagccccagcagugggugcugcccuccuacagcgggcggaacaccccgaacgugcaccucgcccccgccgucgcgcccacguuccccggcgagcagcugcuguucuuccgcuccaccaugccggggugcagcggcuaccccaacauggaccucgacugccugcugccccaggagugggugcaguacuucuaccaggaggccgcccccgcccaguccgacguggcgcuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacgcuggcccccaugggcaacgggaccggccgccgccgguga

SEQ ID NO: 12091 - RNA, 1617 nt, Artificial Sequence
  derived and/or modified sequence opt1 from VP1__Norovirus_and/or_Norovirus-like__KM268095
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgagaccaaccagaacaccaaguucacgcccgucggggugauccaggacggcagcaccacccaccgcaacgagccccagcagugggugcugcccuccuacagcgggcggaacaccccgaacguccaccucgcccccgccguggcgcccacguuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgguga

SEQ ID NO: 12092 - RNA, 1617 nt, Artificial Sequence
  derived and/or modified sequence opt1 from VP1__Norovirus_and/or_Norovirus-like__KM268094
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 12093 - RNA, 1617 nt, Artificial Sequence
  derived and/or modified sequence opt1 from VP1__Norovirus_and/or_Norovirus-like__KM268093
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12094 - RNA, 1617 nt, Artificial Sequence
  derived and/or modified sequence opt1 from VP1__Norovirus_and/or_Norovirus-like__KM198591
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 12095 - RNA, 1617 nt, Artificial Sequence
  derived and/or modified sequence opt1 from VP1__Norovirus_and/or_Norovirus-like__KM198589
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcggggccuucgugguccagccgcagaacggccggugcaccaccgacggggugcugcugggcaccacgcagcucucccccgucaacaucugcaccuuccgcggcgacgugacccacaucgccgggagccggaacuacaccaugaaccuggccucccugaacuggaacaacuacgaccccacggaggagaucccggcgccccucggcacccccgacuucguggggaagauccagggcguccugacccagaccacgaagggggacggcagcacccgcggccacaaggccaccguguacaccggguccgcccccuucacgccgaagcugggcagcgugcaguucagcaccgacaccgagaacgacuucgagauccaccagaacaccaaguucacgcccgucggggugauccaggacggcgggaccacccaccggaacgagccccagcagugggugcuccccuccuacagcggccgcgacguccacaacgugcaccuggccccggccguggcgcccaccuuccccggcgagcagcuccucuucuuccgguccacgaugcccgggugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcaccgcagcggcuacgugaccguggcccacaccgggcagcacgaccuggucaucccgcccaacggcuacuuccgguucgacuccugggugaaccaguucuacacccucgcccccaugggcaacgggacgggccgccgccgguga

SEQ ID NO: 12096 - RNA, 1617 nt, Artificial Sequence
  derived and/or modified sequence opt1 from VP1__Norovirus_and/or_Norovirus-like__KM198576
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgaggcccaccagaacaccaaguucacccccgugggggucauccaggacggcgggacgacccaccgcaacgagccccagcagugggugcuccccuccuacagcggccgggacgugcacaacguccaccuggccccggcgguggcccccaccuuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacacggggcgcguccucuucgagugcaagcugcacaagccgggcuacgugaccguggcccacaccgggcagcacgaccuggugaucccgcccaacggcuacuuccgguucgacagcugggucaaccaguucuacacccucgcccccaugggcaacgggaccggccgccggcgcuga

SEQ ID NO: 12097 - RNA, 1617 nt, Artificial Sequence
  derived and/or modified sequence opt1 from VP1__Norovirus_and/or_Norovirus-like__KM198564
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccgggggcgcccccuucaccccgaagcugggguccgugcaguucagcacggacaccgagaacgacuucgaggcccaccagaacaccaaguucacccccgugggcgucauccaggacgggggcacgacccaccgcaacgagccccagcagugggugcuccccagcuacuccggccgggacgugcacaacguccaccuggccccggcgguggcccccaccuuccccggggagcagcuccucuucuuccgcagcaccaugcccggcugcuccggguacccgaacauggaccuggacugccugcucccccaggagugggugcagcacuucuaccaggaggccgcccccgcgcagagcgacgucgcccugcugcgguucgugaaccccgacacgggccgcguccucuucgagugcaagcugcacaaguccggguacgugaccguggcccacaccggccagcacgaccuggugaucccgcccaacggcuacuuccgguucgacagcugggucaaccaguucuacacccucgcccccauggggaacggcaccgggcgccggcgcuga

SEQ ID NO: 12098 - RNA, 1617 nt, Artificial Sequence
  derived and/or modified sequence opt1 from VP1__Norovirus_and/or_Norovirus-like__KJ716355
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgguga

SEQ ID NO: 12099 - RNA, 1617 nt, Artificial Sequence
  derived and/or modified sequence opt1 from VP1__Norovirus_and/or_Norovirus-like__KJ685408
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagacgauccucgccgggaacgccuucaccgcgggcaagaucaucuucgccgccgucccgcccaacuucccgaccgaggggcugucccccagccaggugaccauguucccccacaucaucguggacguccggcagcuggagcccgugcucaucccgcugcccgacgugcgcaacaacuucuaccacuacaaccagacgaacgaccccaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucagcgugcccguccugaccguggaggagaugacgaacucccgguuccccaucccccuggagaagcuguucaccggcccgagcuccgccuucgugguccagccccagaacgggcgcugcaccaccgacggcgugcuccuggggacgacccagcucagccccgucaacaucugcaccuuccggggcgacgugacccacaucuccggcagccgcaacuacacgaugaaccuggccucccagaacuggaacagcuacgacccgaccgaggagauccccgcgccccuggggacccccgacuucgugggcaagauccaggggguccucacccagacgacccggaccgacggcagcacccgcgggcacaaggccacgguguacaccggcuccgccgacuucagcccgaagcugggccgggugcaguucgccaccgacaccgacaacgacuucgagacgaaccagaacaccaaguucacccccgucggggugauccaggacggcgggaccacgcaccagaacgagccccagcagugggugcugcccuccuacagcggccgcgacacccacaacguccaccucgccccggccguggcccccaccuuccccggggagcagcugcuguucuuccgguccaccaugcccggcugcagcggcuacccgaacauggaccucgacugccugcugccccaggagugggugcaguacuucuaccaggaggcggcccccgcccaguccgacgucgcccuccugcgcuucgugaaccccgacaccgggcgggugcuguucgagugcaagcuccacaagagcggcuacgucacgguggcgcacaccgggcagcacgaccuggugaucccgcccaacggcuacuuccgcuucgacuccugggucaaccaguucuacacccuggcccccauggggaacggcaccggccggcgccgcuga

SEQ ID NO: 12100 - RNA, 1617 nt, Artificial Sequence
  derived and/or modified sequence opt1 from VP1__Norovirus_and/or_Norovirus-like__KJ144999
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggggcgcccccuucaccccgaagcugggguccgugcaguucagcacggacaccgagaacgacuucgagacccaccagaacaccaaguucacgcccgucggcgugauccaggacgggagcaccacccaccgcaacgagccccagcagugggugcuccccaacuacuccggccggaacguccacaacgugcaccuggccccggccguggcgcccaccuuccccggcgagcagcuccucuucuuccgcagcacgaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacggggccggccgccggcgcuga

SEQ ID NO: 12101 - RNA, 1617 nt, Artificial Sequence
  derived and/or modified sequence opt1 from VP1__Norovirus_and/or_Norovirus-like__KF060016
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccgucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucaccggcagccgcaacuacaccaugaaccuggccucccagaacuggaacagcuacgacccgacggaggagauccccgcgccccuggggacccccgacuucgugggcaagauccagggggugcucacccagaccacgcggaccaacggcagcacccgcgggcacaaggccaccgucuacacgggcuccgccgacuucagcccgaagcugggccgggugcaguucgccaccgacaccgacaacgacuucgagaccaaccagaacacgaaguucacccccgugggggucauccaggacggcuccaccacgccccgcaacgagccccagcagugggugcugccgagcuacuccgggcggaacauccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgguga

SEQ ID NO: 12102 - RNA, 1617 nt, Artificial Sequence
  derived and/or modified sequence opt1 from VP1__Norovirus_and/or_Norovirus-like__KC517367
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgccagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccugcuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccaggggaugcugacccagaccaccaagggcgacggguccacgcggggccacaaggccaccguguacaccggcagcgcccccuucaccccgaagcuggggagcguccaguucgagacggacaccgagaacgacuucgagacccaccagaacaccaaguucacgcccgugggcgugauccaggacgggggcaccgcccaccgcaacgagccccagcaguggguccuccccuccuacagcgggcggaacgugccgaacgugcaccuggcccccgccgucgcccccaccuuccccggcgagcagcuccucuucuuccgcuccaccaugccgggcugcagcggguaccccaacauggaccuggacugccugcucccccaggagugggugcagcacuucuaccaggaggccgcgcccgcccaguccgacguggcccugcugcgguucgucaacccggacacgggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcaccgggcgccggcgcuga

SEQ ID NO: 12103 - RNA, 1617 nt, Artificial Sequence
  derived and/or modified sequence opt1 from VP1__Norovirus_and/or_Norovirus-like__KC517366
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaacagcgccucccugaacuggaacaacuacgaccccaccgaggagaucccggcgccccuggggacgcccgacuucgugggcaagauccaggggaugcucacccagaccaccaagggcgacgggagcacgcggggccacaaggccaccgucuacaccggcagcgcccccuucaccccgaagcugggguccgugcaguucgagacggacaccgagaacgacuucgagacccaccagaacaccaaguucacgcccgugggcgucauccaggacgggggcaccacccaccgcaacgagccccagcagugggugcugcccagcuacuccgggcggaacgugccgaacguccaccucgcccccgccguggcgcccaccuuccccggcgagcagcugcuguucuuccgcagcacgaugccgggcugcuccggguaccccaacauggaccucgacugccugcugccccaggagugggugcagcacuucuaccaggaggccgcccccgcccagagcgacgucgcgcuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacggcacggggcgccggcgcuga

SEQ ID NO: 12104 - RNA, 1617 nt, Artificial Sequence
  derived and/or modified sequence opt1 from VP1__Norovirus_and/or_Norovirus-like__KC517359
augaagauggccagcaacgacgccucccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcgccuggagcccgugcucaucccgcugcccgacguccggaacaacuucuaccacuacaaccaguccaacgacagcaccaucaagcugaucgccaugcucuacacgccccugcgcgcgaacaacgccggcgaggacguguucaccguguccugccggguccugacccgccccagcccggacuucgacuucaucuuccucgugccgcccaccguggagucccggaccaagcccuucacgguccccauccugaccguggaggagaugaccuacagccgcuuccccaucccccuggagaagcuguucaccggccccuccagcgccuucgugguccagccgcagaacgggcggugcacgaccgacggcgugcugcuggggaccacccagcucucccccgucaacaucugcacguuccgcggcgacgugacccacaucgccggcagccggaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcgcggccacaaggccaccgucuacaccggcagcgcccccuucaccccgaagcugggguccgugcaguucgagacggacaccgagaacgacuucgagacccaccagaacaucaaguucacccccgugggcgucauccaggacgggggcacgacccaccggaacgagccccagcagugggugcuccccagcuacuccgggcgcaacgugccgaacguccaccuggcccccgccguggcgcccaccuuccccggcgagcagcuccucuucuuccggagcaccaugccgggcugcuccggguaccccaacauggaccuggacugccugcucccccaggagugggugcagcacuucuaccaggaggccgcccccgcccagagcgacgucgcgcugcugcgcuucgugaacccggacacgggccggguccucuucgagugcaagcugcacaaguccggguacgugaccguggcccacaccggccagcacgaccugaucaucccgcccaacggguacuuccgcuucgacagcugggugaaccaguucuacacccucgcccccaugggcaacggcaccgggcggcgccgcuga

SEQ ID NO: 12105 - RNA, 1617 nt, Artificial Sequence
  derived and/or modified sequence opt1 from VP1__Norovirus_and/or_Norovirus-like__KC409303
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacccaccgcaacgagccccagcaguggguccugcccagcuacuccggccggaacauccacaacgugcaccucgccccggccguggcccccaccuuccccggggagcagcugcuguucuuccgcagcacgaugcccggcugcuccggcuacccgaacauggaccucgacugccugcugccccaggaguggguccaguacuucuaccaggaggcggcccccgcccagagcgacguggcccuccugcgguucgugaaccccgacaccgggcgcguccuguucgagugcaagcuccacaaguccggcuacgugaccguggcgcacaccgggcagcacgaccuggucaucccgcccaacggcuacuuccgguucgacagcugggugaaccaguucuacacccuggcccccauggggaacggcacgggccgccgccgguga

SEQ ID NO: 12106 - RNA, 1617 nt, Artificial Sequence
  derived and/or modified sequence opt1 from VP1__Norovirus_and/or_Norovirus-like__JX459608
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagacgccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 12107 - RNA, 1617 nt, Artificial Sequence
  derived and/or modified sequence opt1 from VP1__Norovirus_and/or_Norovirus-like__JQ320073
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgaggacgucuucaccguguccugccgcgugcugacccggccgagccccgacuucgacuucaucuuccucgucccgcccaccguggagucccgcacgaagcccuucaccgugcccauccugaccgucgaggagaugaccaacagccgguuccccaucccccuggagaagcuguucacgggcccguccggggccuucgugguccagccccagaacggccgcugcaccaccgacggggugcuccugggcaccacgcagcucagccccgugaacaucugcaccuuccggggcgacgucacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccguguccacgggggacguccacuucaccccgaagcugggcagcauccaguucaacaccgacaccaacaacgacuucgagacggggcagaacaccaaguucacccccgugggcgugguccaggacgggaacggcacccaccagaacgagccccagcagugggugcugcccuccuacagcggccggacggggcacaacgugcaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacguggcccuccugcgguucgucaaccccgacaccgggcgcgugcuguucgagugcaagcuccacaaguccggcuacgugaccgucgcccacacgggccagcacgaccuggugaucccgcccaacggguacuuccgguucgacagcugggugaaccaguucuacacccuggcgcccaugggcaacgggaccggccgccggcgcuga

SEQ ID NO: 12108 - RNA, 1617 nt, Artificial Sequence
  derived and/or modified sequence opt1 from VP1__Norovirus_and/or_Norovirus-like__HM802552
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccacccaccgcaacgagccccagcagugggugcugcccgacuacagcgggcggacgguccacaacgugcaccucgccccggccguggcccccaccuuccccggcgagcagcugcuguucuuccgcuccaccaugcccggcugcagcggguacccgaacauggaccucgacugccugcugccccaggaguggguccagcacuucuaccaggaggccgcgcccucccagagcgacguggcccuccugcgguucgugaaccccgacaccggccgcguccuguucgagugcaagcuccacaaggccggguacgugaccguggcccacacgggccagcacgaccuggucaucccgcccaacggguacuuccgguucgacuccugggugaaccaguucuacacccuggcgcccaugggcaacggcgccgggcgccgccgguga

SEQ ID NO: 12109 - RNA, 1617 nt, Artificial Sequence
  derived and/or modified sequence opt1 from VP1__Norovirus_and/or_Norovirus-like__AB541320
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggccagccgcacgaagcccuucuccguccccagcgugaccguggaggagaugaccaacucccgguuccccaucccccuggagaagcuguucaccggcccgagcuccgccuucgucgugcagccccagaacgggcgcugcacgaccgacggcguccuccuggggaccacccagcugagccccgugaacaucugcacguuccggggcgacgugacccacaucaccggcucccgcaacuacaccaugaaccucgccacgcagaacuggaacagcuacgacccgaccgaggagauccccgcgccccuggggacccccgacuucgucggcaagauccagggggugcugacccagacgacccgggccgacggcagcacccgcgggcacaaggccaccguguacacgggcuccgccgacuucgccccgaagcucggccggguccaguucgccaccgacaccgacaacgacuucgacgcgaaccagaacaccaaguucacgcccgugggggugauccaggacggcgacaccgcccaccgcaacgagccccagcaguggguccugcccagcuacuccgggcggaacagccacaacgugcaccuggccccgaccguggcccccaccuuccccggcgagcagcuccuguucuuccgcuccacgaugcccgggugcagcggcuacccgaacauggaccuggacugccuccugccccaggaguggguccaguacuucuaccaggaggcggcccccgcccaguccgacguggcccugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacccuggcgcccaugggcaacgggacgggccgccgccgguga

SEQ ID NO: 12110 - RNA, 1617 nt, Artificial Sequence
  derived and/or modified sequence opt1 from VP1__Norovirus_and/or_Norovirus-like__AB541227
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccgggacguccacaacgugcaccuggccccggccguggcgcccaccuuccccggcgagcagcuccucuucuuccgcagcacgaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 12111 - RNA, 1617 nt, Artificial Sequence
  derived and/or modified sequence opt1 from VP1__Norovirus_and/or_Norovirus-like__AB504318
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggccugcugacccagaccaccaagggggacggcagcacgcggggccacaaggccaccgucuacaccggguccgcccccuucaccccgaagcucggcggggugcaguucagcacggacaccgagaacgacuucgagacccaccagaacaccaaguucacgcccgugggcgucauccaggacgggagcaccacccaccgcaacgagccccagcagugggugcugcccuccuacagcggccggaacgugcacaacguccaccuggccccggccguggcgcccaccuuccccggcgagcagcuccuguucuuccgcuccacgaugcccgggugcagcggcuacccgaacauggaccuggacugccuccugccccaggagugggugcagcacuucuaccaggaggccgcccccgcccaguccgacgucgcgcugcuccgguucgugaaccccgacaccgggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccaugggcaacgggacgggccgccggcgcuga

SEQ ID NO: 12112 - RNA, 1617 nt, Artificial Sequence
  derived and/or modified sequence opt1 from VP1__Norovirus_and/or_Norovirus-like__AB504311
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcaccuacaacggcuacgccgggggcuucgaggugcaggucauccucgccgggaacgccuucaccgcgggcaagaucaucuucgccgccgugccgcccaacuucccgaccgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugacgaacagccgguuccccaucccccuggagaagcuguucaccggccccuccagcgccuucgugguccagccgcagaacgggcgcugcaccaccgacggcgugcuccuggggacgacccagcucucccccgucaacaucugcaccuuccggggcgacgugacccacaucgccggcacgcagaacuacaccaugaaccuggccagccagaacuggaacaacuacgaccccaccgaggagaucccggcgccccuggggacccccgacuucgugggcaagauccaggggguccucacgcagaccacccgccgggacggcuccacccgcgggcacaaggccacggugagcaccggcagcgugcacuucacccccaagcugggcuccguccaguucagcaccgacacguccaacgacuucgagaccgggcagaacacccgguucaccccggugggcgugguccaggacgggagcacgacccaccagaacgagccccagcagugggugcugcccaacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcaagcuccacaaguccggcuacgugacggucgcccacaccgggcagcacgaccuggugaucccgcccaacggcuacuuccgcuucgacagcugggugaaccaguucuacacccuggcccccauggggaacggcgcgggccggcgccgcuga

SEQ ID NO: 12113 - RNA, 1617 nt, Artificial Sequence
  derived and/or modified sequence opt1 from VP1__Norovirus_and/or_Norovirus-like__FJ537135
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugagcccggaccucaaccccuaccugucccaccugagccgcauguacaacggcuacgccggcggguucgagguccaggugauccucgccggcaacgccuucacggccgggaagaucaucuucgcggccaucccgcccaacuucccgaccgagggccugucccccagccaggugaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggccaacaacgcgggggacgacguguucaccgucagcugccgcgugcucacccggcccuccccggacuucgacuucaucuuccuggugccgcccaccgucgagagccgcacgaagcccuucaccgugcccauccugaccguggaggagauguccaacagccgguuccccaucccccucgagaagcuguacaccggccccuccagcgccuucgucgugcagccgcagaacggccgcugcacgaccgacggggugcugcucggcaccacccagcuguccgccgucaacaucugcaacuuccgcggggacgugacgcgggucggcaucagccacgacuacaccaugaaccuggugagccagaacuggaacaacuacgaccccaccgaggagauccccgccccgcucggcacccccgacuucguggggaagauccagggccugcugacgcagaccacccgggccgacggguccacccgcgcgcacaaggccacggucagcaccggcuccgugcacuucacccccaagcucgggagcgugcaguucaccacggacaccaacaacgacuuccagaccggccagaacaccaaguucacgcccgucggcgugauccaggacggggaccaccaccagaacgagccgcagcagugggugcugcccaacuacuccggcaccagcgggcacaacguccaccuggcccccgccguggcccccaccuucccgggcgagcagcuccuguucuuccgguccaccaugcccgggugcagcggcuaccccaacaugaaccuggacugccuccugccccaggagugggugucccacuucuaccaggaggcggccccggcccagagcgacgucgcccugcuccgcuucgugaaccccgacacgggccgggugcuguucgagugcaagcugcacaaguccggguacaucaccgucgcgcacaccggccccuacgaccucgugaucccgcccaacggguacuuccgcuucgacagcugggugaaccaguucuacacccuggcccccaugggcaacggguccggccggaagcgcgucuga

SEQ ID NO: 12114 - RNA, 1617 nt, Artificial Sequence
  derived and/or modified sequence opt1 from VP1__Norovirus_and/or_Norovirus-like__GQ413969
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggagcaacuacgaccccacggaggagaucccggcgccccuggggacccccgacuucgugggcaagauccaggggaugcucacccagaccacgggccgcgacggguccacccggggccacaaggccaccguccugaccggcagcgccgacuucgcccccaagcuggggcgcgugcaguucgccacggacaccgacaacgacuucgagagcggcgagaacaccaaguucaccccggugggggucauccaggacggcuccacgacccaccggaacgagccccagcagugggugcuccccaacuacagcgggcgcaccggccacaacgugcaccuggcgcccgccgucgccccgaccuaccccggcgagcagcuccucuucuuccgguccacgaugcccgggugcagcggcuaccccaacauggaccuggacugccugcucccgcaggagugggugcgccacuucuaccaggaggccgcgcccgcccaguccgacguggcccugcugcgguucgucaaccccgacaccgggcgcgugcuguucgagugcaagcugcacaagcccggcuacgugaccgucgcccacaccgggcagcacgaccuggugaucccgcccaacggcuacuuccgcuucgacagcugggugaaccaguucuacacccucgcccccaugggcaacgggacgggccggcgccgguga

SEQ ID NO: 12115 - RNA, 1617 nt, Artificial Sequence
  derived and/or modified sequence opt1 from VP1__Norovirus_and/or_Norovirus-like__EU839592
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccgccuacaccggcagcgcccccuucaccccgaagcuggggagcgugcaguucuccacggacaccgagaacgacuucgagacccaccagaacaccaaguucgcccccgugggcgucauccaggacgggggcacgacccaccgcaacgagccccagcagugggugcuccccagcuacuccgggcggaacgugccgaacguccaccuggcgcccgccguggcccccaccuuccccggcgagcagcuccucuucuuccgcagcaccaugccgggcugcuccggguaccccaacauggaccuggacugccugcucccccaggagugggugcagcacuucuaccaggaggccgcgcccgcccagagcgacgucgcccugcugcgguucgugaacccggacacgggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcaccgggcgccggcgcuga

SEQ ID NO: 12116 - RNA, 1617 nt, Artificial Sequence
  derived and/or modified sequence opt1 from VP1__Norovirus_and/or_Norovirus-like__EU839587
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcgccuaccggaugaaccuggccagccagaacuggaacaacuacgacccgacggaggagauccccgcgccccuggggacccccgacuucgugggcaagauccaggggaugcucacccagaccacgaagggcgacggguccacccgcggccacaaggccaccgucagcaccggcagcguggacuucacgccgaagcugggguccgugcaguucgccaccgacaccgacaacgacuucgagaccggccagaacacgcgguucacccccgucggggugauccaggacggcagcuccacccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacuccugggugaaccaguucuacacgcuggcccccaugggcaacggcgccgggcgccgccgguga

SEQ ID NO: 12117 - RNA, 1617 nt, Artificial Sequence
  derived and/or modified sequence opt1 from VP1__Norovirus_and/or_Norovirus-like__EU839583
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccgcccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacuccugggugaaccaguucuacacgcuggcccccaugggcaacggcgccgggcgccgccgguga

SEQ ID NO: 12118 - RNA, 1617 nt, Artificial Sequence
  derived and/or modified sequence opt1 from VP1__Norovirus_and/or_Norovirus-like__AB303931
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggacccacaacuacaccaugaaccuggccagccagaacuggaacaacuacgaccccacggaggagaucccggcgccccugggcacccccgacuucguggggcgcauccagggcaugcucacccagaccacgcgcggggacggcuccacccggggccacaaggccaccgucagcaccggggacgugcacuucacgcccaagcugggcuccauccaguucaacaccgacaccaacaacgacuucgagaccgggcagaacacgaaguucaccccggugggcgucgugcaggacgggaacggcgcccaccagaacgagccccagcagugggugcugcccagcuacagcggccggaccgggcacaacguccaccucgcccccgccguggcgccgaccuuccccggcgagcagcugcuguucuuccgcuccacgaugcccgggugcagcggcuaccccaacaugaaccucgacugccugcugccgcaggagugggugcagcacuucuaccaggaggccgcccccgcccaguccgacgucgcgcuccugcgguucgugaaccccgacaccgggcgcgugcuguucgagugcaagcuccacaagagcggcuacgucaccguggcccacaccggccagcacgaccuggugaucccgcccaacggguacuuccgguucgacuccugggucaaccaguucuacacccuggcccccaugggcaacgggacgggccgccggcgcuga

SEQ ID NO: 12119 - RNA, 1617 nt, Artificial Sequence
  derived and/or modified sequence opt1 from VP1__Norovirus_and/or_Norovirus-like__KY341923
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccuuccccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 12120 - RNA, 1617 nt, Artificial Sequence
  derived and/or modified sequence opt1 from VP1__Norovirus_and/or_Norovirus-like__KX514317
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugaccguggaggagaugaccaacagccgguuccccgccacccuggacaagcuguucacgggccccuccagcaccuucgucgugcagccccagaacgggcgcugcaccaucgacggcgagcugcuggggaccacgcagcucuccagcgucaacaucugcaccuuccggggcgacgugacccacccgcgcgacagcaagaucuacaccaugaaccuggccucccccaacuggaacaacuacgaccccacggaggagaucccggcgccccugggcacccccgacuucguggggaagauccagggcaugcucacccagaccacgaagggggagggcagcacccgggggcaccgcgccaccgucuacgugggcuccgccaacuacgcccccaagcugggccgggugcaguucgagaccgacacgaccgacgaccuggacgcccaccagaacaccaaguucaccccggucgggguggugcagggcggggagagccccaagggcuccgagccccagcaguggguccuccccaacuacagcggggccaacacguucaacgugcaccuggccccggcgguggcccccaacuuccccggcgagcagcuccucuucuuccgcuccacccugcccggcugcgggggccacccgaacauggaccuggacugccuccugccccaggaguggguccagcacuucuaccaggaggccgcccccgcgcagagcgacguggcccugcuccgguucgugaaccccgacaccucccgcguccuguucgagugcaagcugcacaagagcggguacgugaccguggcccacacgggccaguacgaccucguccugccguccaacggguacuuccgguucgacagcugggugaaccaguucuacacccuggcccccaugggcaacggcaccgggcgccggcgcuga

SEQ ID NO: 12121 - RNA, 1617 nt, Artificial Sequence
  derived and/or modified sequence opt1 from VP1__Norovirus_and/or_Norovirus-like__KU678204
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggaugcucacccagaccacccggacggacggcuccacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 12122 - RNA, 1617 nt, Artificial Sequence
  derived and/or modified sequence opt1 from VP1__Norovirus_and/or_Norovirus-like__KX158283
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccggcugcccaucccccucgagcgccuguucaccggcccguccagcgccuucgucgugcagccccagaacgggcggugcaccacggacggcgugcugcucgggaccacccagcugucccccgucaacaucugcaccuuccgcggcgacgugacgcacaucaccggcagccacaacuacaccaugaaccuggccucccagaacuggaacaacuacgacccgaccgaggagauccccgcgccccucgggacgcccgacuucgugggcaagauccaggggguccugacccagaccacccggacggacggcagcacccgcgggcacaaggccaccguguacaccggcagcgccgaguucgccccgaagcugggccgggugcaguucgagacggacaccaaccacgacuucgaggccaaccagaacaccaaguucacccccgucggggugauccaggacggcuccacgacccaccgcaacgagccccagcagugggugcuccccagcuacuccgggcggaacacccacaacguccaccuggccccggcgguggcccccaccuuccccggcgagcagcuccuguucuuccgcagcacgaugcccgggugcuccggcuacccgaacauggaccuggacugccugcucccccaggagugggugcaguacuucuaccaggaggccgcccccgcgcagagcgacgucgcccugcugcgguucgugaaccccgacaccggccgcguccucuucgagugcaagcugcacaaguccggguacaucaccguggcccacaccggccagcacgaccuggugaucccgcccaacggguacuuccgguucgacagcugggugaaccaguucuacacccucgcccccaugggcaacgggacgggccgccgccgguga

SEQ ID NO: 12123 - RNA, 1617 nt, Artificial Sequence
  derived and/or modified sequence opt1 from VP1__Norovirus_and/or_Norovirus-like__KX354088
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcuguucacgguccccauccugaccguggaggagaugaccaacucccgguuccccaucccccucgagaagcuguucaccggccccagcuccgccuucgugguccagccccagaacgggcgcugcacgaccgacggcgugcugcucgggaccacccagcugagcccggucaacaucugcacguuccggggcgacgugacccacaucgccggcucccgcaacuacaccaugaaccuggccagccucaacuggaacaacuacgaccccaccgaggagauccccgcgccgcuggggacgcccgacuucgugggcaagauccaggggguccugacccagaccaccaagggcgacggguccacgcggggccacaaggccaccguguacaccggcagcgccgacuucacccccaagcucgggagcgugcaguucgccacggacaccgagaacgacuucgagacccaccagaacacccgcuucacgcccgucggcgugauccaggacgggggcaccacccaccggaacgagccgcagcagugggugcugcccuccuacagcgggcgcaacguccacaacgugcaccuggcccccgcgguggcccccaacuucccgggcgagcagcuccuguucuuccgguccaccaugcccggcugcagcggguaccccaacauggaccuggacugccuccugccccaggaguggguccagcacuucuaccaggaggccgccccggcgcaguccgacguggcccugcuccgcuucgugaaccccgacacgggccggguccuguucgagugcaagcugcacaagagcggguacgugaccguggcccacaccggccaguacgaccucgucaucccgcccaacggguacuuccgcuucgacuccugggugaaccaguucuacacccuggcccccaugggcaacggcaccgggcggcgccgcuga

SEQ ID NO: 12124 - RNA, 1617 nt, Artificial Sequence
  derived and/or modified sequence opt1 from VP1__Norovirus_and/or_Norovirus-like__KX354032
augaagauggccagcuccgacgccagccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgucggcgacgacguguucaccguguccugccgcguccugacccggccgagccccgacuucgacuucaucuuccucgugccgcccaccguggagucccgcaccaagcccuucagcguccccgugcugacggucgaggagaugaccaacucccgguuccccaucccccuggagaagcuguucaccggcccgagcuccgccuucguggugcagccccagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgacccgaccgaggagauccccgcgccccuggggacgcccgacuucgucggcaagauccagggggugcucacccagaccacccggacggacggcagcacccgcgggcacaaggccaccguguacaccggcuccgccgacuucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacacccacaacgugcaccucgccccggccguggcgcccaccuuccccggcgagcagcugcuguucuuccgcuccacgaugcccgggugcagcggcuacccgaacauggaccucgacugccugcugccccaggaguggguccaguacuucuaccaggaggccgcccccgcccaguccgacguggcgcuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggggccggccgccgccgguga

SEQ ID NO: 12125 - RNA, 1617 nt, Artificial Sequence
  derived and/or modified sequence opt1 from VP1__Norovirus_and/or_Norovirus-like__KX354015
augaagauggccagcuccgacgccagccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacacccacaacguccaccucgccccggcgguggcccccaccuuccccggcgagcagcugcuguucuuccgcuccacgaugcccgggugcagcggcuacccgaacauggaccucgacugccugcugccccaggacugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacggggccggccgccgccgguga

SEQ ID NO: 12126 - RNA, 1617 nt, Artificial Sequence
  derived and/or modified sequence opt1 from VP1__Norovirus_and/or_Norovirus-like__KX353999
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucagcggcucccgcaacuacaccaugaaccuggccagccagaacuggaacagcuacgacccgaccgaggagauccccgcgccccuggggacgcccgacuucgugggcaagauccaggggguccucacccagaccaccuccacggacggcagcacccgggggcacaaggccaccguguacaccggcuccgccgacuucagcccgaagcugggccgcgugcaguucgccacggacaccgacaacgacuucgagaccaaccagaacaccaaguucacgcccgucggggugauccaggacggcgggaccacccaccggaacgagccccagcagugggugcugcccuccuacagcggccgcaacauccacaacguccaccucgccccggccguggcccccaccuuccccggggagcagcugcuguucuuccgguccacgaugcccggcugcagcggcuacccgaacauggaccucgacugccugcugccccaggagugggugcaguacuucuaccaggaggcggcccccgcccaguccgacgucgcccuccugcgcuucgugaaccccgacaccgggcgggugcuguucgagugcaagcuccacaagagcggcuacgucaccguggcgcacaccgggcagcacgaccuggugaucccgcccaacggcuacuuccgcuucgacuccugggucaaccaguucuacacccuggcccccauggggaacggcacgggccggcgccgcuga

SEQ ID NO: 12127 - RNA, 1617 nt, Artificial Sequence
  derived and/or modified sequence opt1 from VP1__Norovirus_and/or_Norovirus-like__KX353987
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucuccguccccgugcugaccguggaggagaugaccaacagccgguuccccaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacaucagcggcagccacaacuacaccaugaaccuggccucccagaacuggaacagcuacgaccccaccgaggagaucccggcgccccuggggacgcccgacuucgucggcaagauccagggggugcucacccagaccaccaagacgaacggcuccacccgcgggcacaaggccaccguguacaccggcagcgccgacuucucccccaagcugggccggguccaguucgccacggacaccgacaacgacuucgagaccaaccagaacaccaaguucacgccggugggggugauccaggacggcagcaccacgccccgcaacgagccccagcaguggguccugcccuccuacagcgggcggaacacccacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggcggcccccgcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccggcgcuga

SEQ ID NO: 12128 - RNA, 1617 nt, Artificial Sequence
  derived and/or modified sequence opt1 from VP1__Norovirus_and/or_Norovirus-like__KX353970
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccaguacgaccuggucaucccgcccaacggguacuuccgguucgacuccugggugaaccaguucuacacgcuggcccccaugggcaacgggaccggccgccgccgguga

SEQ ID NO: 12129 - RNA, 1617 nt, Artificial Sequence
  derived and/or modified sequence opt1 from VP1__Norovirus_and/or_Norovirus-like__KU985156
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12130 - RNA, 1617 nt, Artificial Sequence
  derived and/or modified sequence opt1 from VP1__Norovirus_and/or_Norovirus-like__KU985155
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggucaaccagaacaccaaguucacccccgugggggugauccaggacggcgggacgacccaccgcaacgagccccagcaguggguccugcccuccuacagcggccggaacacccacaacgugcaccucgccccggccguggcgcccaccuuccccggggagcagcugcuguucuuccgcuccacgaugcccggcugcagcggcuacccgaacauggaccucgacugccugcugccccaggaguggguccaguacuucuaccaggaggccgcccccgcccaguccgacguggcgcuccugcgguucgugaaccccgacaccgggcgcguccuguucgagugcaagcuccacaagccgggcuacgugaccguggcccacaccgggcagcacgaccuggucaucccgcccaacggcuacuuccgguucgacagcugggugaaccaguucuacacccuggcccccauggggaacggcacgggccgccgccgguga

SEQ ID NO: 12131 - RNA, 1617 nt, Artificial Sequence
  derived and/or modified sequence opt1 from VP1__Norovirus_and/or_Norovirus-like__KM514075
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccgaccgggacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12132 - RNA, 1617 nt, Artificial Sequence
  derived and/or modified sequence opt1 from VP1__Norovirus_and/or_Norovirus-like__AB972484
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccgggacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12133 - RNA, 1617 nt, Artificial Sequence
  derived and/or modified sequence opt1 from VP1__Norovirus_and/or_Norovirus-like__KT780391
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucuccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgccguggcgcccaccuuccccggggagcagcugcuguucuuccgcagcacgaugccgggcugcuccggcuaccccaacauggaccucgacugccugcugccccaggagugggugcaguacuucuaccaggaggccgcccccgcccagagcgacgucgcgcuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12134 - RNA, 1617 nt, Artificial Sequence
  derived and/or modified sequence opt1 from VP1__Norovirus_and/or_Norovirus-like__KT780390
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcugcuggggaccacccagcucucccccgucaacaucugcaccuuccggggcgacgugacgcacaccaccggcagccacaacuacaccaugaaccuggccucccagaacuggagcaacuacgacccgacggaggagauccccgcgccccuggggacccccgacuucgugggcaagauccaggggguccucacccagaccacgcgcaccgacggcagcacccgggggcacaaggccaccguguacacgggcuccgccgacuucgccccgaagcugggccgcgugcaguucgagaccgacaccgaccacgaccuggaggccaaccagaacaccaaguucacgcccgucggggugauccaggacggcggggccacccaccggaacgagccccagcagugggugcuccccagcuacuccggccgcaacaccccgaacguccaccuggcgcccgccguggcccccaccuuccccggggagcagcuccucuucuuccggagcacgaugccgggcugcuccggcuaccccaacauggaccuggacugccugcucccccaggagugggugcaguacuucuaccaggaggccgcgcccgcccagagcgacgucgcccugcugcgcuucgugaacccggacaccgggcggguccucuucgagugcaagcugcacaaguccggcuacgugaccguggcccacaccgggcagcacgaccuggugaucccgcccaacggcuacuuccgcuucgacagcugggucaaccaguucuacacccucgcccccauggggaacggcacgggccggcgccgcuga

SEQ ID NO: 12135 - RNA, 1617 nt, Artificial Sequence
  derived and/or modified sequence opt1 from VP1__Norovirus_and/or_Norovirus-like__KT780376
augaagauggccagcuccgacgccaaccccagcgacggcuccgcggccaaccuggugcccgaggucaacaacgaggugcucgcccuggagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccacaacuacaccaugaaccuggccucccagaacuggagcaacuacgacccgaccgaggagauccccgcgccccucgggacgcccgacuucgugggcaagauccaggggguccugacccagaccacccgcacggacggcagcacccgggggcacaaggccaccguguacaccggcuccgccgacuucgccccgaagcugggccgcgugcaguucgagacggacaccaaccacgacuucgaggccaaccagaacaccaaguucacccccgucggggugauccaggacggcagcacgacccaccggaacgagccccagcagugggugcuccccuccuacagcgggcgcaacaccccgaacguccaccuggcccccgcgguggcccccaccuuccccggcgagcagcuccuguucuuccgguccacgaugccggggugcagcggcuaccccaacauggaccuggacugccugcucccccaggagugggugcaguacuucuaccaggaggccgcccccgcgcaguccgacgucgcccugcugcgcuucgugaacccggacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacgggacgggccggcgccgcuga

SEQ ID NO: 12136 - RNA, 1617 nt, Artificial Sequence
  derived and/or modified sequence opt1 from VP1__Norovirus_and/or_Norovirus-like__KT780375
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacaucacgcacaucaccggcagccgcaacuacaccaugaaccuggccucccagaacuggagcaacuacgacccgaccgaggagauccccgcgccccuggggacgcccgacuucgucggcaagauccagggggugcucacccagaccacccggacggacggcagcacccgcgggcacaaggccaccguguacaccggcuccgccgacuucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgcgguggcccccaccuuccccggcgagcagcugcuguucuuccgcuccacgaugccggggugcagcggcuaccccaacauggaccucgacugccugcugccccaggaguggguccaguacuucuaccaggaggccgcccccgcgcaguccgacguggcccuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12137 - RNA, 1617 nt, Artificial Sequence
  derived and/or modified sequence opt1 from VP1__Norovirus_and/or_Norovirus-like__LC016607
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccaacacccacacguaccgcaugaaccuggccagccagaacuggaacaacuacgacccgaccgaggagauccccgcgccccugggcacccccgacuucguggggaagauccagggcaugcucacccagacgaccaagggggacggcuccacccgggggcacaaggccaccgucagcacgggcagcguggacuucaccccgaagcugggcuccgugcaguucaccaccgacacggacaacgacuucgagaccgggcagaacacccgcuucacccccgucggcgugauccaggacgggaacggcgcccaccggaacgagccccagcagugggugcugcccgacuacagcgggggcacgguccacaacgugcaccucgccccggccguggcccccaccuuccccggcgagcagcugcuguucuuccgcuccaccaugcccgggugcagcggcuacccgaacauggaccucgacugccugcugccccaggaguggguccagcacuucuaccaggaggccgcgcccgcccaguccgacguggcccuccugcgguucgugaaccccgacaccgggcgcguccuguucgagugcaagcuccacaagaccggcuacgugacgguggcccacaccgggcagcacgaccuggucaucccgcccaacggcuacuuccgguucgacagcugggugaaccaguucuacacccuggcgcccaugggcaacggggccggccgccggcgcuga

SEQ ID NO: 12138 - RNA, 1617 nt, Artificial Sequence
  derived and/or modified sequence opt1 from VP1__Norovirus_and/or_Norovirus-like__KP241915
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcgccgacggcagcacgcgggggcacaaggccaccguguacaccggcuccgccgacuucgccccgaagcugggccgcgugcaguucgagaccgacacgaaccacgacuucgaggccaaccagaacaccaaguucacccccgucggggugauccaggacggcgggaccacgcaccggaacgagccccagcagugggugcugcccagcuacuccggccgcaacaccccgaacguccaccucgcgcccgccguggcccccaccuuccccggggagcagcugcuguucuuccggagcaccaugccgggcugcuccggcuaccccaacauggaccucgacugccugcugccccaggagugggugcaguacuucuaccaggaggccgcgcccgcccagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcaccggccggcgccgcuga

SEQ ID NO: 12139 - RNA, 1617 nt, Artificial Sequence
  derived and/or modified sequence opt1 from VP1__Norovirus_and/or_Norovirus-like__KM514065
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccggcuucgccccgaagcuggggcgggugcaguucgagacggacaccgaccacgacuucgaggccaaccagaacaccaaguucacccccgucggcgugauccaggacgggagcacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12140 - RNA, 1617 nt, Artificial Sequence
  derived and/or modified sequence opt1 from VP1__Norovirus_and/or_Norovirus-like__KM268097
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccaaccacgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcuga

SEQ ID NO: 12141 - RNA, 1617 nt, Artificial Sequence
  derived and/or modified sequence opt1 from VP1__Norovirus_and/or_Norovirus-like__KM268084
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcuggcccggccgucccccgacuucgacuucaucuuccucgucccgcccaccguggagagccgcaccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggagcaacuacgacccgaccgaggagauccccgcgccccuggggacccccgacuucgugggcaagauccaggggguccucacgcagaccaccaagaccgacggcagcacgcgggggcacaaggccaccguguacaccggcuccgccgacuucgccccgaagcugggccgcgugcaguucgagaccgacacggaccacgacuucgaggccaaccagaacaccaaguucacccccgucggggugauccaggacggcagcaccacgcaccggaacgagccccagcagugggugcugcccuccuacagcgggcgcaacaccccgaacguccaccucgcgcccgccguggcccccaccuuccccggcgagcagcugcuguucuuccgguccaccaugccggggugcagcggcuaccccaacauggaccucgacugccugcugccccaggagugggugcaguacuucuaccaggaggccgcgcccgcccaguccgacgucgcccuccugcgcuucgugaacccggacacgggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggaccggccggcgccgcuga

SEQ ID NO: 12142 - RNA, 1617 nt, Artificial Sequence
  derived and/or modified sequence opt1 from VP1__Norovirus_and/or_Norovirus-like__KJ649704
augaagauggccagcuccgacgccaaccccagcgacggcuccgcggccaaccuggugcccgaggucaacaacgaggugcucgcccuggagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccacaacuacaccaugaaccuggccucccagaacuggaacaacuacgacccgaccgaggagauccccgcgccccucgggacgcccgacuucgugggcaagauccaggggguccugacccagaccacccgcacggacggcagcacccgggggcacaaggccaccguguacaccggcagcgccgacuucuccccgaagcugggccgcauccaguucgagacggacaccaaccacgacuucgaggccaaccagaacaccaaguucacccccgugggggucauccaggacggcgggacgacccaccggaacgagccccagcagugggugcuccccagcuacuccggccgcaacaccccgaacgugcaccuggcccccgccgucgcgcccaccuuccccggggagcagcuccuguucuuccggagcacgaugccgggcugcuccggcuaccccaacauggaccuggacugccugcucccccaggagugggugcaguacuucuaccaggaggccgcccccgcccagagcgacguggcgcugcugcgcuucgucaacccggacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccggcgccgcuga

SEQ ID NO: 12143 - RNA, 1617 nt, Artificial Sequence
  derived and/or modified sequence opt1 from VP1__Norovirus_and/or_Norovirus-like__KC577174
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagcagcaacuacaccaugaaccuggccucccagaacuggaacagcuacgaccccaccgaggagaucccggcgccccuggggacgcccgacuucgucggcaagauccagggggugcucacccagaccacccgcacggacggcuccacccgggggcacaaggccaccguguacaccggcagcgccgacuucucccccaagcugggccgcguccaguucgccacggacaccgacaacgacuucgagaccaaccagaacaccaaguucacgccggugggggugauccaggacggcgccaccacccaccggaacgagccccagcaguggguccugcccagcuacuccgggcgcaacacccacaacgugcaccucgcccccgccguggcgccgacguuccccggcgagcagcugcuguucuuccggagcaccaugcccgggugcuccggcuaccccaacauggaccucgacugccugcugccgcaggaguggguccaguacuucuaccaggaggccgcccccgcccagagcgacguggcgcuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccaguucuacacgcuggcccccaugggcaacgggaccggccggcgccgcuga

SEQ ID NO: 12144 - RNA, 1617 nt, Artificial Sequence
  derived and/or modified sequence opt1 from VP1__Norovirus_and/or_Norovirus-like__KF177451
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgacaacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugaucccccaggagugggugcaguacuucuaccaggaggccgcccccgcgcaguccgacgucgcccugcuccgguucgugaaccccgacaccgggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccauggggaacggcacgggccgccgccgguga

SEQ ID NO: 12145 - RNA, 1617 nt, Artificial Sequence
  derived and/or modified sequence opt1 from VP1__Norovirus_and/or_Norovirus-like__KF177429
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacuccgggcagcacgaccuggugaucccgcccaacggcuacuuccgguucgacagcugggucaaccaguucuacacccuggcccccauggggaacggcaccggccgccgccgguga

SEQ ID NO: 12146 - RNA, 1617 nt, Artificial Sequence
  derived and/or modified sequence opt1 from VP1__Norovirus_and/or_Norovirus-like__KF060005
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucacgccgaagcugggccggguccaguucgccaccgacaccgacaacgacuucgugaccaaccagaacacgaaguucacccccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacacgggccagcacgaccuggugaucccgcccaacggguacuuccgguucgacagcugggugaaccaguucuacacccuggcccccaugggcaacgggaccggccgccgccgguga

SEQ ID NO: 12147 - RNA, 1617 nt, Artificial Sequence
  derived and/or modified sequence opt1 from VP1__Norovirus_and/or_Norovirus-like__JX439821
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcuccagccgcaacuacaccaugaaccuggccagccagaacugguccagcuacgacccgaccgaggagauccccgcgccccugggcacgcccgacuucgucgggaagauccagggcgugcucacccagaccacccggacggacggguccacccgcggccacaaggccaccguguacaccgggagcgccgacuucuccccgaagcugggccggguccaguucgacacggacaccgacaacgacuucgagaccaaccagaacaccaaguucacgcccgugggcgugauccaggacgggagcaccaccuaccgcaacgagccccagcaguggguccugcccuccuacagcggccggaacacccacaacgugcaccucgccccggccguggcccccacguuccccggggagcagcugcuguucuuccgcuccaccaugcccggcugcagcggguacccgaacauggaccucgacugccugcugccccaggaguggguccaguacuucuaccaggaggccgcgcccgcccaguccgacguggcccuccugcgguucgugaaccccgacaccggccgcguccuguucgagugcaagcuccacaagagcggcuacgugaccguggcccacaccgggcagcacgaccuggucaucccgcccaacggcuacuuccgguucgacuccugggugaaccaguucuacacgcuggcgcccauggggaacggcaccgggcgccgccgguga

SEQ ID NO: 12148 - RNA, 1617 nt, Artificial Sequence
  derived and/or modified sequence opt1 from VP1__Norovirus_and/or_Norovirus-like__KC517361
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccguccacaccggcagcgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgguga

SEQ ID NO: 12149 - RNA, 1617 nt, Artificial Sequence
  derived and/or modified sequence opt1 from VP1__Norovirus_and/or_Norovirus-like__KC175378
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugucccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcagcgugcaguucuccaccgacaccgagaacgacuucgagacccaccagaacacgaaguucacccccgucggggugauccaggacggcgggaccacccaccgcaacgagccccagcagugggugcuccccagcuacuccggccgggacguccacaacgugcaccuggccccggccguggcgcccacguuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgccggcgcuga

SEQ ID NO: 12150 - RNA, 1617 nt, Artificial Sequence
  derived and/or modified sequence opt1 from VP1__Norovirus_and/or_Norovirus-like__JX459648
augaagauggccagcaacgacgccaaccccuccgagggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccgggaccauccgcugguccgcgccccugggcccggaccugaaccccuaccucucccaccuggcccggauguacaacggcuacgccgggggcuucgaggugcaggucauccuggccgggaacgccuucacggccggcaagaucaucuucgccgccgugccgcccaacuucccgaccgaggggcucagccccucccaggugaccauguucccccacaucaucgucgacgugcgccagcuggagcccgugcugaucccgcuccccgacguccggaacaacuucuaccacuacaaccagagcaacgacuccaccaucaagcugaucgccaugcuguacacgccccuccgcgcgaacaacgccggcgaggacguguucaccgugagcugccggguccugacccgccccuccccggacuucgacuucaucuuccuggugccgcccaccguggagagccggacgaagcccuucaccguccccauccucaccguggaggagaugaccaacucccgcuucagcaucccccuggagaagcuguucacgggccccuccggggccuucgugguccagccccagaacggccggugcaccaccgacggggugcuccugggcaccacgcagcugagcccggucaacaucugcaccuuccgcggcgacgugacccacaucgccgggucccggaacuacaccaugaaccucgccgcgcugaacuggaacaacuacgaccccacggaggagauccccgccccgcugggcacccccgacuucguggggaagauccagggcguccucacccagaccacgaagggggacggcagcacccgcggccacaaggccaccguguacaccggguccgccgacuucacgcccaagcugggcagcgugcaguucagcaccgacaccgagaacgacuucgagucccaccagaacaccaaguucacgcccgucggggugauccaggacggcagcaccacccaccggaacgagccgcagcagugggugcugcccuccuacagcgggcgcaacguccacaacgugcaccucgcccccgcgguggcccccaccuucccgggcgagcagcugcuguucuuccgguccacgaugcccggcugcagcggguaccccaacauggaccucgacugccugaucccccaggaguggguccagcacuucuaccaggaggccgccccggcgcaguccgacguggcccugcuccgcuucgugaaccccgacaccggccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacggcgccgggcggcgccgcuga

SEQ ID NO: 12151 - RNA, 1617 nt, Artificial Sequence
  derived and/or modified sequence opt1 from VP1__Norovirus_and/or_Norovirus-like__JX459635
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucauccuggacguccggcagcucgagcccgugcugaucccgcugcccgacgugcgcaacaacuucuaccacuacaaccagagcaacgacuccaccaucaagcucaucgccaugcuguacacgccccugcgggcgaacaacgccggcgaggacgucuucaccgugagcugccgcgugcucacccggcccuccccggacuucgacuucaucuuccuggucccgcccaccguggagagccgcaccaagcccuucacggugcccauccugaccgucgaggagaugaccaacucccgguuccccaucccccucgagaagcuguucaccggccccagcggggccuucguggugcagccgcagaacggccgcugcacgaccgacgggguccugcucggcaccacccagcugucccccgugaacaucugcacguuccggggcgacgucacccacaucgccgggagccgcaacuacaccaugaaccuggccucccucaacuggaacaacuacgaccccaccgaggagaucccggcgccccugggcacgcccgacuucguggggaagauccagggcgugcugacccagaccaccaagggggacggcagcacgcggggccacaaggccaccgucuacaccggguccgcccccuucaccccgaagcucggcagcgugcaguucagcacggacaccgagaacgacuucgagacccaccagaacaccaaguucacgcccgugggggucauccaggacggcuccaccacccgccggaacgagccccagcagugggugcugcccagcuacuccgggcgcaacgcccacaacgugcaccuggccccggcggucgcccccaccuuccccggcgagcagcuccuguucuuccggagcacgaugcccggcugcuccggguacccgaacauggaccuggacugccuccugccccaggagugggugcagcacuucuaccaggaggccgcccccgcgcagagcgacguggcccugcuccgcuucgucaaccccgacaccggccgggugcuguucgagugcaagcugcacaaguccggguacgugaccgucgcccacaccggccagcacgaccucgugaucccgcccaacggguacuuccgcuucgacagcugggugaaccaguucuacacccuggcccccaugggcaacggcacggggcggcgccgcuga

SEQ ID NO: 12152 - RNA, 1617 nt, Artificial Sequence
  derived and/or modified sequence opt1 from VP1__Norovirus_and/or_Norovirus-like__JX459624
augaagauggccagcaacgacgcccaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgaccccacggaggagaucccggcgccccucggcccgcccgacuucguggggaagauccagggcguccugacccagaccaccaagggggacggcuccacgcggggccacaaggccaccguguacaccgggagcgcccccuucacccccaagcugggcuccgugcaguucagcacggacaccgagaacgacuucgagacccaccagaacaccaaguucacgcccgucggggugauccaggacggcgggaccacccaccgcaacgagccccagcagugggugcucccgagcuacuccggccggaacguccacaacgugcaccuggcccccgccguggcgcccaccuuccccggcgagcagcuccucuucuuccgcagcacgaugccggggugcuccggcuaccccaacauggaccuggacugccugcucccccaggaguggguccagcacuucuaccaggaggccgcccccgcccagagcgacguggcgcugaugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccaugggcaacgggacgggccgccggcgcuga

SEQ ID NO: 12153 - RNA, 1617 nt, Artificial Sequence
  derived and/or modified sequence opt1 from VP1__Norovirus_and/or_Norovirus-like__JX459614
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguacgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcuga

SEQ ID NO: 12154 - RNA, 1617 nt, Artificial Sequence
  derived and/or modified sequence opt1 from VP1__Norovirus_and/or_Norovirus-like__HM635103
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccugcuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgaccuggagaccaaccagaacaccaaguucacgcccgugggggugauccaggacggcuccaccacgccccgcaacgagccgcagcaguggguccuccccagcuacuccgggcggaacauccacaacgugcaccuggcccccgccguggcccccaccuucccgggcgagcagcuccucuucuuccgcagcaccaugcccgggugcuccggcuaccccaacauggaccuggacugccugcucccccaggaguggguccaguacuucuaccaggaggcggccccggcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacccucgcccccaugggcaacgggacgggccgccgccgguga

SEQ ID NO: 12155 - RNA, 1617 nt, Artificial Sequence
  derived and/or modified sequence opt1 from VP1__Norovirus_and/or_Norovirus-like__JQ613522
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcgacuacaccaugaaccuggccagccugaacuggaacaacuacgaccccaccgaggagaucccggcgccccucggcacgcccgacuucguggggaagauccagggcaugcugacccagaccaccaagggggacggcuccacgcggggccacaaggccaccgucuacaccgggagcgcccccuucaccccgaagcugggcagcgugcgcuucuccacggacaccgagaacgacuucgagacccaccagaacaccaaguucacgcccgugggggucauccaggacggcagcaccacccaccggaacgagccccagcagugggugcuccccuccuacagcgggcgcgacgugcacaacguccaccuggccccggccguggcgcccaccuuccccggcgagcagcuccucuucuuccgguccacgaugcccggcugcagcggguacccgaacauggaccuggacugccugcucccccaggagugggugcagcacuucuaccaggaggccgcccccgcccaguccgacgucgcgcugcugcgcuucgugaaccccgacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacggcacggggcggcgccgcuga

SEQ ID NO: 12156 - RNA, 1617 nt, Artificial Sequence
  derived and/or modified sequence opt1 from VP1__Norovirus_and/or_Norovirus-like__AB629942
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacacccagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaagucccgguacgugaccguggcccacaccgggcagcacgaccuggucaucccgcccaacggcuacuuccgcuucgacagcugggugaaccaguucuacacccucgcccccauggggaacggcacgggccggcgccgcuga

SEQ ID NO: 12157 - RNA, 1617 nt, Artificial Sequence
  derived and/or modified sequence opt1 from VP1__Norovirus_and/or_Norovirus-like__GQ856457
augaagauggccagcaacgacgccaaccccuccgacggccccgcggccaaccuggugcccgaggucaacaacgaggugauggcccucgagcccguggucggggccgccaucgcggcccccguggccggccagcagaacgugaucgacccguggauccgcaacaacuucguccaggcccccgggggcgaguucaccgugagcccccggaacgcgcccggggagauccugugguccgccccgcugggccccgaccucaaccccuaccugagccaccuggcccgcauguacaacggcuacgccgggggcuucgaggugcaggucauccucgccgggaacgcguucaccgccggcaagaucaucuucgccgccgugcccccgaacuuccccacggaggggcugucccccagccaggugaccauguucccccacaucaucgucgacgugcggcagcuggagccggugcucaucccccugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagcuccaacuacaccaugaaccuggccagccugaacuggaacaacuacgacccgaccgaggagauccccgcgccccucgggacgcccgacuucgugggcaagauccaggggguccugacccagaccaccaagggcgacggguccacgcgcggccacaaggccaccguguacaccggcagcgccccguucacccccaagcuggggagcgugcaguucuccacggacacccagaacgacuucgagacccaccagaacaccaaguucacgcccgucggcgugauccaggacgggggcaccacccaccggaacgagccccagcagugggugcucccgagcuacuccgggcgcaacguccagaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaagucccgcuacgugaccguggcccacaccgggcagcacgaccuggucaucccgcccaacggcuacuuccgguucgacagcugggugaaccaguucuacacccucgcccccauggggaacggcacgggccgccggcgcuga

SEQ ID NO: 12158 - RNA, 1617 nt, Artificial Sequence
  derived and/or modified sequence opt1 from VP1__Norovirus_and/or_Norovirus-like__EU876883
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccaugagcccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagcgccucuucaccggcccgagcuccgccuucgugguccagccccagaacgggcggugcacgaccgacggcgugcugcuggggaccacccagcucagccccgucaacaucugcacguuccgcggcgacgugacccacaucgccggcacccaggaguacaccaugaaccuggccucccagaacuggaacaacuacgacccgacggaggagauccccgcgccccuggggacccccgacuucgugggcaagauccaggggguccucacccagaccacgcggcgcgacggcagcacccgggggcacaaggccaccgugagcaccggcuccgugcacuucacgccgaagcugggccgcauccaguucagcaccgacaccuccaacgacuucgagaccgggcagaacacgcgguucacccccgucggcguggugcaggacgggggcaccacccaccagaacgagccccagcaguggguccugcccaacuacagcgggcgcgacggccacaacgugcaccucgccccggccguggcccccuccuuccccggcgagcagcugcuguucuuccggagcacgaugcccgggugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccaugggcaacgggacgggccgccggcgcuga

SEQ ID NO: 12159 - RNA, 1617 nt, Artificial Sequence
  derived and/or modified sequence opt1 from VP1__Norovirus_and/or_Norovirus-like__AB447455
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccuguccuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugaugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacgcuggcccccaugggcaacgggaccggccgccggcgcuga

SEQ ID NO: 12160 - RNA, 1617 nt, Artificial Sequence
  derived and/or modified sequence opt1 from VP1__Norovirus_and/or_Norovirus-like__EU078409
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacacccgguucacccccgugggcgucgugcaggacgggaacggcacccaccagaacgagccccagcagugggugcugcccuccuacagcggccgcacggggcacaacguccaccucgccccggccguggcccccaccuuccccggcgagcagcugcuguucuuccggagcaccaugcccgggugcuccggcuacccgaacaugaaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacacgggccagcacgaccuggugaucccgcccaacggguacuuccgcuucgacagcugggucaaccaguucuacacccuggcgcccaugggcaacgggaccggccggcgccgcuga

SEQ ID NO: 12161 - RNA, 1617 nt, Artificial Sequence
  derived and/or modified sequence opt1 from VP1__Norovirus_and/or_Norovirus-like__AB303928
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcacccugcggggcgacgugacccacaucgccgggacccacaacuacacgaugaaccuggccucccagaacuggaacaacuacgacccgaccgaggagauccccgcgccccucggcacccccgacuucguggggcgcauccagggcguccugacccagacgacccgcggggacggcagcacccggggccacaaggccaccguguccacgggggacgugcacuucaccccgaagcugggcagcguccaguucaacaccgacaccaacaacgacuucgagaucgggcagaacacgcgguucacccccgugggcgugguccaggacgggaacggcacccaccagaacgagccccagcagugggugcuccccuccuacagcggccgcaccgggcacaacgugcaccuggccccggccgucgcccccacguuccccggcgagcagcuccucuucuuccggagcaccaugcccgggugcuccggcuacccgaacaugaaccuggacugccugcucccccaggagugggugcagcacuucuaccaggaggccgcgcccgcccagagcgacguggcccugcugcgcuucgucaaccccgacaccgggcggguccucuucgagugcaagcugcacaaguccggcuacgugaccguggcccacaccggccagcacgaccuggugaucccgcccaacggguacuuccgcuucgacagcugggugaaccaguucuacacgcucgcgcccaugggcaacgggaccggccggcgccgcuga

SEQ ID NO: 12162 - RNA, 1617 nt, Artificial Sequence
  derived and/or modified sequence opt1 from VP1__Norovirus_and/or_Norovirus-like__AY502023
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgaggacguguucaccgugagcugccgcguccucacccggccgucccccgacuucgacuucaucuuccuggugccgcccaccguggagagccgcacgaagcccuucaccguccccauccugaccguggaggagaugaccaacucccgguuccccaucccccucgagaagcuguucacgggcccgagcggggccuucgugguccagccccagaacggccgcugcaccaccgacggggugcugcucggcaccacgcagcugucccccgucaacaucugcaccuuccggggcgacgugacccacaucgccgggacccacaacuacacgaugaaccuggccagccagaacuggaacaacuacgacccgaccgaggagauccccgcgccccucggcacccccgacuucguggggcgcauccagggcaugcugacccagacgacccgcggggacggcuccacccggggccacaaggccaccgucagcacgggggacgugcacuucaccccgaagcugggcuccauccaguucaacaccgacaccaacaacgacuucgagacggggcagaacaccaaguucacccccgugggcgucgugcaggacgggaacggcacccaccagaacgagccccagcagugggugcuccccagcuacuccggccggacggggcacaacguccaccuggccccggccguggcccccaccuuccccggcgagcagcuccucuucuuccgcagcaccaugcccgggugcagcggcuacccgaacaugaaccuggacugccugcucccccaggagugggugcagcacuucuaccaggaggccgcgcccgcccaguccgacgucgcccugcugcgguucgugaaccccgacaccgggcgcgugcuguucgagugcaagcugcacaagagcggcuacgucaccguggcccacacgggccagcacgaccuggugaucccgcccaacggguacuuccgguucgacuccugggucaaccaguucuacacccucgcgcccaugggcaacgggaccggccgccggcgcuga

SEQ ID NO: 12163 - RNA, 1617 nt, Artificial Sequence
  derived and/or modified sequence opt1 from VP1__Norovirus_and/or_Norovirus-like__KU678202
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggaugcucacccagaccacccgcacggacggcagcacccgggggcacaaggccaccgucuacaccggcuccgccgacuucgccccgaagcugggccgcgugcaguucgagacggacaccaacaacgacuucgaggccaaccagaacaccaaguucacccccgugggggucauccaggacggcgggacgacccaccggaacgagccccagcagugggugcugcccagcuacuccggccgcaacaccccgaacgugcaccucgcccccgcggucgcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacguggcccuccugcgcuucgucaacccggacaccgggcgggugcuguucgagugcaagcuccacaaguccggcuacgugaccgucgcccacaccgggcagcacgaccuggugaucccgcccaacggcuacuuccgcuucgacagcugggugaaccaguucuacacccuggcccccauggggaacggcgccggccggcgccgcuga

SEQ ID NO: 12164 - RNA, 1617 nt, Artificial Sequence
  derived and/or modified sequence opt1 from VP1__Norovirus_and/or_Norovirus-like__KX371607
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccgccggcgcuga

SEQ ID NO: 12165 - RNA, 1617 nt, Artificial Sequence
  derived and/or modified sequence opt1 from VP1__Norovirus_and/or_Norovirus-like__KX354112
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaucggccagcacgaccuggugaucccgcccaacggguacuuccgguucgacagcugggucaaccaguucuacacccuggcccccaugggcaacgggaccggccgccgccgguga

SEQ ID NO: 12166 - RNA, 1617 nt, Artificial Sequence
  derived and/or modified sequence opt1 from VP1__Norovirus_and/or_Norovirus-like__KX353993
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucgugcucgccgggaacgccuucacggcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgacgacguguucaccgucuccugccgcgugcugacccggccgagccccgacuucgacuucaucuuccucgugccgcccaccgucgagucccgcacgaagcccuucagcgugcccgugcugaccgucgaggagaugaccaacucccgguuccccaucccccuggagaagcuguucaccggcccgagcuccgccuucgugguccagccccagaacgggcgcugcacgaccgacggcgugcuccuggggaccacccagcucagccccgugaacaucugcacguuccggggcgacgucacccacaucccgggcucccgcaacuacaccaugaaccuggccagccagaacuggaacagcuacgaccccaccgaggagauccccgcgccccuggggacgccggacuucgugggcaagauccagggggugcucacccagaccacccggacgaacggcuccacccgcgggcacaaggccaccgucuacaccggcagcgccgacuucucccccaagcugggccgggugcaguucgccacggacaccgacaacgacuucgagaccaaccagaacaccaaguucacgcccgugggggucauccaggacggcgccaccacgccccgcaacgagccgcagcagugggugcugcccagcuacuccgggcggaacauccacaacgugcaccucgcccccgccgucgcgcccaccuucccgggcgagcagcugcuguucuuccgcagcaccaugcccgggugcuccggcuaccccaacauggaccucgacugccugcugccccaggagugggugcaguacuucuaccaggaggccgccccggcccagagcgacguggcgcuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 12167 - RNA, 1617 nt, Artificial Sequence
  derived and/or modified sequence opt1 from VP1__Norovirus_and/or_Norovirus-like__KR131762
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcaugcugacccagaccaccaagggggacggcuccacgcggggccacaaggccaccgucuacaccgggagcgcccccuucaccccgaagcugggcagcgugcaguucuccacggacaccgagaacgacuucgagacccaccagaacaccaaguucacgcccgugggggucauccaggacggcagcaccacccaccgcaacgagccccagcagugggugcuccccuccuacagcgggcgggacgugcacaacguccaccuggccccggccguggcgcccaccuuccccggcgagcagcuccucuucuuccgcuccacgaugcccggcugcagcggguacccgaacauggaccuggacugccugcucccccaggagugggugcagcacuucuaccaggaggccgcccccgcccaguccgacgucgcgcugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 12168 - RNA, 1617 nt, Artificial Sequence
  derived and/or modified sequence opt1 from VP1__Norovirus_and/or_Norovirus-like__AB972519
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12169 - RNA, 1617 nt, Artificial Sequence
  derived and/or modified sequence opt1 from VP1__Norovirus_and/or_Norovirus-like__AB972498
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggagcucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12170 - RNA, 1617 nt, Artificial Sequence
  derived and/or modified sequence opt1 from VP1__Norovirus_and/or_Norovirus-like__AB972488
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgugccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgccguggcgcccaccuuccccggcgagcagcugcuguucuuccgcuccacgaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12171 - RNA, 1617 nt, Artificial Sequence
  derived and/or modified sequence opt1 from VP1__Norovirus_and/or_Norovirus-like__AB972483
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgagaccaaccagaacaccaaguucacgcccgucggggugauccaggacggcgggaccacccaccgcaacgagccccagcagugggugcugcccuccuacagcggccggaacaccccgaacguccaccucgcccccgccguggcgcccacguuccccggggagcagcugcuguucuuccgcuccaccaugccgggcugcagcggcuaccccaacauggaccucgacugccugcugccccaggagugggugcaguacuucuaccaggaggccgcccccgcccaguccgacgucgcgcuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgguga

SEQ ID NO: 12172 - RNA, 1617 nt, Artificial Sequence
  derived and/or modified sequence opt1 from VP1__Norovirus_and/or_Norovirus-like__KP864106
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccgaccacgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcuga

SEQ ID NO: 12173 - RNA, 1617 nt, Artificial Sequence
  derived and/or modified sequence opt1 from VP1__Norovirus_and/or_Norovirus-like__KR904216
augaagauggccagcuccgacgccaaccccagcgacggcuccaccgcgaaccuggcccccgaggugaacaacgaggucauggcccucgagcccguggugggggccgccaucgcggcccccgucgccggccagaagaacgugaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcacgaagcccuucuccgcccccgugcugaccgucgaggagaugaccaacagccgguuccccaucccccuggagaagcuguucaccggcccguccagcgccuucguggugcagccccagaacgggcgcugcacgaccgacggcguccuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcugccguccuacagcgggcggaacacccacaacgugcaccucgcccccgcggucgcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcgggaccuggugaucccgcccaacggguacuuccgcuucgacuccugggugaaccaguucuacagccuggcccccaugggcaacgggacgggccgccggcgcuga

SEQ ID NO: 12174 - RNA, 1617 nt, Artificial Sequence
  derived and/or modified sequence opt1 from VP1__Norovirus_and/or_Norovirus-like__AB933771
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccucccagaacuggaacagcuacgacccgacggaggagauccccgcgccccuggggacccccgacuucgucggcaagauccagggggugcucacccagaccacgcggaccaacggcagcacccgcgggcacaaggccaccguguacacgggcuccgccgacuucagcccgaagcugggccggguccaguucgccaccgacaccgacaacgacuucgaggccaaccagaacaccaaguucacgcccgugggggugauccaggacggcuccaccacgccccgcaacgagccccagcaguggguccugccgagcuacuccgggcggaacauccacaacgugcaccucgcccccgccguggcgcccaccuuccccggcgagcagcugcuguucuuccgcagcaccaugccggggugcuccggcuaccccaacauggaccucgacugccugcugccccaggaguggguccaguacuucuaccaggaggccgcccccgcccagagcgacguggcgcuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggacgggccgccgccgguga

SEQ ID NO: 12175 - RNA, 1617 nt, Artificial Sequence
  derived and/or modified sequence opt1 from VP1__Norovirus_and/or_Norovirus-like__LC005732
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgccaccgucgcccacaccgggcagcacgaccuggugaucccgcccaacggcuacuuccgcuucgacuccugggugaaccaguucuacacccuggcccccauggggaacggcacgggccgccggcgcuga

SEQ ID NO: 12176 - RNA, 1617 nt, Artificial Sequence
  derived and/or modified sequence opt1 from VP1__Norovirus_and/or_Norovirus-like__KP293591
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccgggccgacggcagcacgcgcgggcacaaggccaccgucuacaccggcagcgccaacuucgccccgaagcugggccgggugcaguucgagaccgacacggaccacgacuucgaggccaaccagaacaccaaguucacccccgugggggucauccaggacggcuccaccacgcaccgcaacgagccccagcagugggugcugcccagcuacuccgggcggaacaccccgaacgugcaccucgcgcccgccgucgcccccaccuuccccggcgagcagcugcuguucuuccgcagcaccaugccggggugcuccggcuaccccaacauggaccucgacugccugcugccccaggagugggugcaguacuucuaccaggaggccgcgcccgcccagagcgacguggcccuccugcgguucgucaacccggacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgguga

SEQ ID NO: 12177 - RNA, 1617 nt, Artificial Sequence
  derived and/or modified sequence opt1 from VP1__Norovirus_and/or_Norovirus-like__KP176396
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccaucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucuccccgaagcugggccgggugcaguucgagacggacaccgaccacgacuucgaggccaaccagaacaccaaguucacccccgugggggucauccaggacggcgggacgacccaccgcaacgagccccagcagugggugcugcccagcuacuccggccggaacaccccgaacgugcaccucgcccccgccgucgcgcccaccuuccccggggagcagcugcuguucuuccgcagcacgaugccgggcugcuccggcuaccccaacauggaccucgacugccugcugccccaggagugggugcaguacuucuaccaggaggccgcccccgcccagagcgacguggcgcuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgguga

SEQ ID NO: 12178 - RNA, 1617 nt, Artificial Sequence
  derived and/or modified sequence opt1 from VP1__Norovirus_and/or_Norovirus-like__KP176394
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccggccgaggagauccccgcgccccuggggacccccgacuucgugggcaagauccaggggguccucacgcagaccacccgcaccgacggcagcacgcgggggcacaaggccaccguguacaccggcuccgccgacuucgccccgaagcugggccgcgugcaguucgagaccgacacggaccgggacuucgaggccaaccagaacaccaaguucacccccgucggggugauccaggacggcgggaccacgcaccgcaacgagccccagcagugggugcugcccagcuacuccggccggaacaccccgaacguccaccucgcgcccgccguggcccccaccuuccccggggagcagcugcuguucuuccgcagcaccaugccgggcugcuccggcuaccccaacauggaccucgacugccugcugccccaggagugggugcaguacuucuaccaggaggccgcgcccgcccagagcgacgucgcccuccugcgguucgugaacccggacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccgccgguga

SEQ ID NO: 12179 - RNA, 1617 nt, Artificial Sequence
  derived and/or modified sequence opt1 from VP1__Norovirus_and/or_Norovirus-like__KP096348
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgacgccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcuga

SEQ ID NO: 12180 - RNA, 1617 nt, Artificial Sequence
  derived and/or modified sequence opt1 from VP1__Norovirus_and/or_Norovirus-like__KP096344
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcagcuacgacccgaccgaggagauccccgcgccccuggggacgcccgacuucgugggcaagauccaggggaugcucacccagaccacccggacggacggcuccacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgguga

SEQ ID NO: 12181 - RNA, 1617 nt, Artificial Sequence
  derived and/or modified sequence opt1 from VP1__Norovirus_and/or_Norovirus-like__KM982946
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgagaccaaccagaacaccaaguucacgcccgucggggugauccaggacggcgggaccacccaccggaacgagccccagcagugggugcugcccagcuacuccggccgcaacaccccgaacguccaccucgcccccgccguggcgcccacguuccccggggagcagcugcuguucuuccggagcaccaugccgggcugcuccggcuaccccaacauggaccucgacugccugcugccccaggagugggugcaguacuucuaccaggaggccgcccccgcccagagcgacgucgcgcuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccgccggcgcuga

SEQ ID NO: 12182 - RNA, 1617 nt, Artificial Sequence
  derived and/or modified sequence opt1 from VP1__Norovirus_and/or_Norovirus-like__KM514070
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacgugaccggcagccgcaacuacaccaugaaccuggccucccagaacuggagcaacuacgacccgaccgaggagauccccgcgccccuggggacgcccgacuucgucggcaagauccagggggugcucacccagaccacccggacggacggcagcacccgcgggcacaaggccaccguguacaccggcuccgccaacuucgccccgaagcugggccggguccaguucgagacggacaccgaccacgacuucgaggccaaccagaacaccaaguucacccccgugggggugauccaggacggcgggacgacccaccgcaacgagccccagcaguggguccugcccagcuacuccggccggaacaccccgaacgugcaccucgcccccgcgguggcccccaccuuccccggggagcagcugcuguucuuccgcagcacgaugccgggcugcuccggcuaccccaacauggaccucgacugccugcugccccaggaguggguccaguacuucuaccaggaggccgcccccgcgcagagcgacguggcccuccugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcacgggccgccgccgguga

SEQ ID NO: 12183 - RNA, 1617 nt, Artificial Sequence
  derived and/or modified sequence opt1 from VP1__Norovirus_and/or_Norovirus-like__KM514061
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagaucauccucgccgggaacgccuucaccgccggcaaggucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccacaacuacaccaugaaccuggccucccagaacuggagcaacuacgacccgaccgaggagauccccgcgccccuggggacgcccgacuucgugggcaagauccagggggugcucacccagaccacccgcacggacggcagcacccgggggcacaaggccaccgucuacaccggcuccgccgacuucgccccgaagcugggccgcgugcaguucgagacggacaccgaccgggacuucgaggccaaccagaacaccaaguucacccccgugggggucauccaggacggcgggacgacccaccgcaacgagccccagcagugggugcugcccagcuacuccggccggaacaccccgaacgugcaccucgcccccgcggucgcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacguggcccuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgguga

SEQ ID NO: 12184 - RNA, 1617 nt, Artificial Sequence
  derived and/or modified sequence opt1 from VP1__Norovirus_and/or_Norovirus-like__KM514060
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucuccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgccguggcgcccaccuuccccggggagcagcugcuguucuuccgcagcacgaugccgggcugcuccggcuaccccaacauggaccucgacugccugcugccccaggagugggugcaguacuucuaccaggaggccgcccccgcccagagcgacgucgcgcuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcgccggccgccgccgguga

SEQ ID NO: 12185 - RNA, 1617 nt, Artificial Sequence
  derived and/or modified sequence opt1 from VP1__Norovirus_and/or_Norovirus-like__KM268079
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccagcuacuccggccggaacaccccgaacgugcaccucgcccccgcggucgcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacguggcccuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgguga

SEQ ID NO: 12186 - RNA, 1617 nt, Artificial Sequence
  derived and/or modified sequence opt1 from VP1__Norovirus_and/or_Norovirus-like__KJ710247
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgaucgaggagaugaccaacagccgguuccccaucccccuggagaagcuguucaccggccccuccagcgccuucgugguccagccgcagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgaccccaccgaggagaucccggcgccccuggggacgcccgacuucgugggcaagauccaggggaugcucacccagaccacccggacggacggcagcacccgcgggcacaaggccaccgucuacaccggcagcgccgacuucgcccccaagcugggccgggugcaguucgagacggacaccgaccacgacuucgaggccaaccagaacaccaaguucaccccgaucggggugauccaggacggcuccacgacccaccgcaacgagccccagcaguggguccugcccagcuacuccgggcggaacacccacaacgugcaccucgcccccgcgguggccccgaccuuccccggcgagcagcugcuguucuuccgcagcacgaugcccgggugcuccggcuaccccaacauggaccucgacugccugcugccgcaggaguggguccaguacuucuaccaggaggccgcccccgcgcagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggacgggccgccgccgguga

SEQ ID NO: 12187 - RNA, 1617 nt, Artificial Sequence
  derived and/or modified sequence opt1 from VP1__Norovirus_and/or_Norovirus-like__KJ685405
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagacgauccucgccgggaacgccuucaccgcgggcaagaucaucuucgccgccgucccgcccaacuucccgaccgaggggcugucccccagccaggugaccauguucccccacaucaucguggacguccggcagcuggagcccgugcucaucccgcugcccgacgugcgcaacaacuucuaccacuacaaccagacgaacgaccccaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucagcgugcccguccugaccguggaggagaugacgaacucccgguuccccaucccccuggagaagcuguucaccggcccgagcuccgccuucgugguccagccccagaacgggcgcugcaccaccgacggcgugcuccuggggacgacccagcucagccccgucaacaucugcaccuuccggggcgacgugacccacaucuccggcagccgcaacuacacgaugaaccuggccucccagaacuggaacagcuacgacccgaccgaggagauccccgcgccccuggggacccccgacuucgugggcaagauccaggggguccucacccagacgacccggaccgacggcagcacccgcgggcacaaggccacgguguacaccggcuccgccgacuucagcccgaagcugggccgggugcaguucgccaccgacaccgacaacgacuucgagacgaaccagaacaccaaguucacccccgucggggugauccaggacggcgggaccacgcaccgcaacgagccccagcagugggugcugcccuccuacagcggccggaacacccacaacguccaccucgccccggccguggcccccaccuuccccggggagcagcugcuguucuuccgcuccaccaugcccggcugcagcggcuacccgaacauggaccucgacugccugcugccccaggagugggugcaguacuucuaccaggaggcggcccccgcccaguccgacgucgcccuccugcgguucgugaaccccgacaccgggcgcgugcuguucgagugcaagcuccacaagagcggcuacgucacgguggcgcacaccgggcagcacgaccuggugaucccgcccaacggcuacuuccgguucgacuccugggucaaccaguucuacacccuggcccccauggggaacggcaccggccgccgccgguga

SEQ ID NO: 12188 - RNA, 1617 nt, Artificial Sequence
  derived and/or modified sequence opt1 from VP1__Norovirus_and/or_Norovirus-like__KF429766
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaucaaccagaacaccaaguucacccccgugggggucauccaggacggcagcacgacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacccuggcccccaugggcaacgggacgggccgccgccgguga

SEQ ID NO: 12189 - RNA, 1617 nt, Artificial Sequence
  derived and/or modified sequence opt1 from VP1__Norovirus_and/or_Norovirus-like__KF060009
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgacgccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12190 - RNA, 1617 nt, Artificial Sequence
  derived and/or modified sequence opt1 from VP1__Norovirus_and/or_Norovirus-like__KF059996
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccaccaagacgaacggcagcacccgggggcacaaggccaccguguacaccggcuccgccgacuucagccccaagcugggccgcguccaguucgccacggacaccgacaacgacuucgagaccaaccagaacaccaaguucacgcccgugggggugauccaggacggcuccaccacgccccggaacgagccgcagcaguggguccugcccagcuacuccgggcgcaacauccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacccuggcccccaugggcaacgggacgggccggcgccgcuga

SEQ ID NO: 12191 - RNA, 1617 nt, Artificial Sequence
  derived and/or modified sequence opt1 from VP1__Norovirus_and/or_Norovirus-like__HF952130
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucuccguccccgugcugaccguggaggagaugaccaacagccgguuccccaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacaucagcggcagccgcaacuacaccaugaaccuggccucccagaacuggaacagcuacgaccccaccgaggagaucccggcgccccuggggacgcccgacuucgucggcaagauccagggggugcucacccagaccaccaagacgaacggcuccacccgggggcacaaggccaccguguacaccggcagcgccgacuucucccccaagcugggccgcguccaguucgccacggacaccgacaacgacuucgagaccaaccagaacaccaaguucacgccggugggggugauccaggacggcagcaccacgccccggaacgagccccagcaguggguccugcccuccuacagcgggcgcaacacccacaacgugcaccucgccccggccguggcccccaccuuccccggcgagcagcugcuguucuuccgguccaccaugcccgggugcagcggcuacccgaacauggaccucgacugccugcugccccaggaguggguccaguacuucuaccaggaggcggcccccgcccaguccgacguggcccuccugcgcuucgugaaccccgacaccggccggguccuguucgagugcaagcuccacaagagcggguacgugaccguggcgcacaccggccagcacgaccuggucaucccgcccaacggguacuuccgcuucgacuccugggugaaccaguucuacacgcuggcccccaugggcaacgggaccggccggcgccgcuga

SEQ ID NO: 12192 - RNA, 1617 nt, Artificial Sequence
  derived and/or modified sequence opt1 from VP1__Norovirus_and/or_Norovirus-like__KC409302
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaucaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggccgccgccgguga

SEQ ID NO: 12193 - RNA, 1617 nt, Artificial Sequence
  derived and/or modified sequence opt1 from VP1__Norovirus_and/or_Norovirus-like__JX459908
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacgacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcuga

SEQ ID NO: 12194 - RNA, 1617 nt, Artificial Sequence
  derived and/or modified sequence opt1 from VP1__Norovirus_and/or_Norovirus-like__JX445166
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccacaacuacaccaugaaccuggccucccagaacuggaacagcuacgaccccaccgaggagauccccgcgccccuggggacgccggacuucgucggcaagauccagggggugcucacccagaccacccgcacgaacggcagcacccgggggcacaaggccaccguguacaccggcuccgccgacuucagccccaagcugggccgcguccaguucgccacggacaccaacaacgacuucgagaccaaccagaacaccaaguucacgcccgugggggugauccaggacggcuccaccacgccccggaacgagccgcagcaguggguccugcccagcuacuccgggcgcaacacccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacgcuggcccccaugggcaacgggaccggccggcgccgcuga

SEQ ID NO: 12195 - RNA, 1617 nt, Artificial Sequence
  derived and/or modified sequence opt1 from VP1__Norovirus_and/or_Norovirus-like__HQ693090
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucgcggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaccgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgcgaugcucuacacgccccugcgggccaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcggggccuucgugguccagccgcagaacggccgcugcaccacggacggggugcugcugggcaccacccagcucucccccgucaacaucugcaccuuccggggcgacgugacgcacaucgccgggagccgcaacuacaccaugaaccuggcgucccugaacuggaacaacuacgaccccaccgaggagaucccggcgccccucggcacccccgacuucguggggaagauccagggcguccugacgcagaccaccaagggggacggcagcacccggggccacaaggccacgguguacaccggguccgcccccuucaccccgaagcugggcagcgugcaguucagcaccgacacggagaacgacuucgagacccaccagaacaccaaguucgcccccgucggggugauccaggacggcuccaccacgcaccgcaacgagccccagcagugggugcuccccagcuacuccgggggcaacguccacaacgugcaccuggccccggccguggcccccaccuuccccggcgagcagcuccucuucuuccggagcaccaugcccgggugcuccggcuacccgaacauggaccuggacugccugcucccccaggaguggguccagcacuucuaccaggaggccgcgcccgcccagagcgacguggcccugcugcgcuucgugaaccccgacaccgggcggguccucuucgagugcaagcugcacaaguccggcuacgugacgguggcccacaccgggcagcacgaccuggucaucccgcccaacggcuacuuccgcuucgacagcugggugaaccaguucuacacccucgcccccaugggcaacgggaccggccggcgccgguga

SEQ ID NO: 12196 - RNA, 1617 nt, Artificial Sequence
  derived and/or modified sequence opt1 from VP1__Norovirus_and/or_Norovirus-like__JN400611
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgaccucaucuuccuggugccgcccaccguggagagccgcaccaagcccuucacgguccccauccugaccguggaggagaugaccaacucccgguuccccaucccccucgagaagcuguucaccggccccagcggggccuucgugguccagccgcagaacggccgcugcacgaccgacggggugcugcucggcaccacccagcugucccccgucaacaucugcacguuccggggcgacgugacccacaucgccgggagccgcaacuacaccaugaaccuggccucccucaacuggaacaacuacgaccccaccgaggagaucccggcgccccugggcacgcccgacuucguggggaagauccagggcguccugacccagaccaccaagggggacggcagcacgcggggccacaaggccaccguguacaccgggggcgcccccuucaccccgaagcucggguccgugcaguucagcacggacaccgagaacgacuucgagacccaccagaacaccaaguucacgcccgucggcgugauccaggacgggagcaccacccaccgcaacgagccccagcagugggugcugcccuccuacagcggccggaacguccacaacgugcaccuggccccggccguggcgcccaccuuccccggcgagcagcuccuguucuuccgcuccacgaugcccgggugcagcggcuacccgaacauggaccuggacugccuccugccccaggaguggguccagcacuucuaccaggaggccgcccccgcccaguccgacguggcgcugcuccgguucgugaaccccgacaccgggcgcguccuguucgagugcaagcugcacaagagcggcuacgugaccguggcccacaccgggcagcacgaccucgucaucccgcccaacggcuacuuccgguucgacuccugggugaaccaguucuacacccuggcccccaugggcaacgggacgggccgccggcgcuga

SEQ ID NO: 12197 - RNA, 1617 nt, Artificial Sequence
  derived and/or modified sequence opt1 from VP1__Norovirus_and/or_Norovirus-like__JN400609
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugggccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccgggcccuccggcgccuucgugguccagccgcagaacgggcgcugcacgaccgacggcgugcugcugggcaccacccagcucagccccgucaacaucugcacguuccgcggggacgugacccacaucgccggcucccggaacuacaccaugaaccuggccagccugaacuggaacaacuacgaccccaccgaggagaucccggcgccccucgggacgcccgacuucgugggcaagauccaggggguccugacccagaccaccaagggcgacggcuccacgcgggggcacaaggccaccguguacaccggcggggcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccagcuacuccggccggaacguccacaacgugcaccuggccccggccguggcgcccaccuuccccggggagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggcuacuuccgguucgacagcugggugaaccaguucuacacccucgcccccauggggaacggcacggggcgccggcgcuga

SEQ ID NO: 12198 - RNA, 1617 nt, Artificial Sequence
  derived and/or modified sequence opt1 from VP1__Norovirus_and/or_Norovirus-like__JQ613517
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggaccccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccggggcgacgugacccacaucgccgggacccaggaguacaccaugaaccuggccucccagaacuggaacaacuacgacccgacggaggagauccccgcgccccugggcacccccgacuucguggggaagauccagggcguccucacccagaccacgcgcggggacggcagcacccgggggcacaaggccaccgugagcaccggcuccgugcacuucacgccgaagcugggccgcauccaguucagcaccgacaccuccaacgacuucgagaccgggcagaacacgcgguucacccccgucggcguggugcaggacgggagcaccacccaccagaacgagccccagcaguggguccugcccaacuacuccggccgcgacagccacaacgugcaccucgccccggccguggcccccuccuuccccggggagcagcugcuguucuuccggagcacgaugcccggcugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccauggggaacggcacgggccggcgccgcuga

SEQ ID NO: 12199 - RNA, 1617 nt, Artificial Sequence
  derived and/or modified sequence opt1 from VP1__Norovirus_and/or_Norovirus-like__JQ478409
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucacggugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggggccgccgguga

SEQ ID NO: 12200 - RNA, 1617 nt, Artificial Sequence
  derived and/or modified sequence opt1 from VP1__Norovirus_and/or_Norovirus-like__GQ856460
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccgaccccagcuccgccuucgugguccagccgcagaacggccgcugcacgaccgacggggugcugcugggcaccacccagcucagccccgucaacaucugcacguuccgcggggacgugacccacaucgccggcucccggaacuacaccaugaaccuggccagccugaacuggaacaacuacgaccccaccgaggagaucccggcgccccucggcacgcccgacuucguggggaagauccagggcguccugacccagaccaccaagggggacggcuccacgcgggggcacaaggccaccguguacaccggcagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggggagcagcuccucuucuuccgcagcacgaugccgggcugcuccggcuaccccaacauggaccuggacugcccccugccccaggaguggguccagcacuucuaccaggaggccgccccggcccagagcgacguggcgcuccugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcacgggccgccggcgcuga

SEQ ID NO: 12201 - RNA, 1617 nt, Artificial Sequence
  derived and/or modified sequence opt1 from VP1__Norovirus_and/or_Norovirus-like__GQ856449
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcacccacaacuacaccaugaaccuggccucccugaacuggaacaacuacgaccccacggaggagaucccggcgccccucgggacccccgacuucgugggcaagauccaggggguccugacccagaccacgaagggcgacgggagcacccgcggccacaaggccaccguguacaccggcuccgcccccuucacgccgaagcuggggagcgugcaguucagcaccgacaccgagaacgacuucgagacccaccagaacacgaaguucacccccgucggcgugauccaggacggguccaccacccaccggaacgagccccagcagugggugcuccccagcuacuccggcgggaacguccagaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacagccgguucgaccccugggugaaccaguucuacacgcucgcccccaugggcaacggcaccgggcgccggcgcuga

SEQ ID NO: 12202 - RNA, 1617 nt, Artificial Sequence
  derived and/or modified sequence opt1 from VP1__Norovirus_and/or_Norovirus-like__EU921344
augaagauggccagcuccgacgccacccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgccuucgugguccagccccagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgacccgaccgaggagauccccgcgccccuggggacccccgacuucgugggcaagauccaggggaugccgacccagacgacccgcggcgacggguccacccggggccacaaggccaccgucagcacgggcagcgugcacuucacccccaagcucggguccgugcaguucagcaccgacaccuccaacgacuucgagacgggccagaacacccgcuucacccccgucgggguggugcaggacggcagcaccacgcaccagaacgagccccagcaguggguccugccgaacuacuccgggcgggacagccacaacgugcaccuggcccccgccguggcccccaccuuccccggcgagcagcuccuguucuuccgcuccaccaugccgggcugcagcggguaccccaacaugaaccuggacugccuccugccccaggaguggguccagcacuucuaccaggaguccgcccccgcgcagagcgacguggcccugcuccgguucgugaacccggacaccggccgcguccuguucgagugcaagcugcacaaguccggguacgugaccguggcccacacgggccagcacgaccucgucaucccgcccaacggguacuuccgguucgacagcugggugaaccaguucuacacccuggcccccaugggcaacggcgcggggcgccggcgcuga

SEQ ID NO: 12203 - RNA, 1617 nt, Artificial Sequence
  derived and/or modified sequence opt1 from VP1__Norovirus_and/or_Norovirus-like__AB541290
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucgugcucgccgggaacgccuucaccgccggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcggggccuucgucgugcagccgcagaacggccgcugcacgaccgacgggguccugcugggcaccacccagcucucccccgugaacaucugcacguuccggggcgacgugacccacaucgccgggagccgcaacuacaccaugaaccuggccucccugaacuggaacaacuacgaccccaccgaggagaucccggcgccccucggcacgcccgacuucgucgggaagauccagggcgugcugacccagaccaccaagggggacggcagcacgcggggccacaaggccaccguguacaccggguccacccccuucacgccgaagcugggcagcguccaguucagcaccgacaccgagaacgacuucgagaaccaccagaacaccaaguucacgcccgugggggugauccaggacggcgggaccacccaccgcaacgagccccagcaguggguccuccccuccuacagcggccggaacgugcagaacgugcaccuggccccggccgucgcccccaccuuccccggcgagcagcuccucuucuuccgcuccacgaugcccgggugcagcggcuacccgaacauggaccuggacugccugcucccccaggagugggugcagcacuucuaccaggaggcggcccccgcccaguccgacguggcccugcugcgguucgucaaccccgacaccgggcgcguccucuucgagugcaagcugcacaagagcggcuacgugaccguggcgcacaccgggcagcacgaccuggugaucccgcccaacggcuacuuccgguucgacuccugggugaaccaguucuacacccucgcccccaugggcaacgggacgggccgccggcgcuga

SEQ ID NO: 12204 - RNA, 1617 nt, Artificial Sequence
  derived and/or modified sequence opt1 from VP1__Norovirus_and/or_Norovirus-like__GQ845322
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcacccccuucacgccgaagcugggcagcgugcaguucuccaccgacaccgagaacgacuucgagacccaccagaacacgaaguucacccccgucggggugauccaggacggcagcaccacccaccgcaacgagccccagcagugggugcuccccuccuacagcgggcgggacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcuga

SEQ ID NO: 12205 - RNA, 1617 nt, Artificial Sequence
  derived and/or modified sequence opt1 from VP1__Norovirus_and/or_Norovirus-like__AB220921
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaccaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcaccaagcccuucaccguccccauccugaccguggaggagaugacgaacagccgguuccccaucccccuggagaagcuguucaccggccccuccagcgccuucgugguccagccgcagaacgggcgcugcaccaccgacggcgugcuccuggggacgacccagcucucccccgucaacaucugcaccuuccggggcgacgugauccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccgcccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacuccugggugaaccaguucuacacgcuggcccccaugggcaacggcgccgggcgccgccgguga

SEQ ID NO: 12206 - RNA, 1617 nt, Artificial Sequence
  derived and/or modified sequence opt1 from VP1__Norovirus_and/or_Norovirus-like__KX514221
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcaccaagcccuucuccguccccauccugacggugggcgagaugaccaacagccgguuccccgugaaccuggagcgccucuucaccgggcccuccagcgccaacgucgugcagccgcagaacggccggugcaccaucgacggggagcugcugggcacgacccagcucuccagcgucaacaucugcaccuuccgcggcgacgugacccacaucggguccacgcaccacuggaccaugaaccuggccagccccaacuggaacaacuacgaccccaccgaggagaucccggcgccccugggcacccccgacuucguggggaagauccagggcaugcucacgcagaccaccaagggggagggcagcacccggggccaccgcgccacggucuacgugggguccgccaacuacgcccccaagcugggccgggugcaguucgagaccgacaccaccaacgaccuggacgcccaccagaacacgaaguucaccccggucgggguggugcagggcggggagagcccccagcgcuccgagccccagcaguggguccuccccagcuacuccggccgggacaccccgaacgugcaccuggcccccgccguggcgcccaccuuccccggcgagcagcuccuguucuuccgcagcacgaucccggggugcggcgggcaccccaacaugaaccuggacugccugcucccccaggaguggguccagcacuucuaccaggaggccgcccccgcccaguccgacguggcgcugcugcgguucgugaacccggacaccagccgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgcaagcgcuga

SEQ ID NO: 12207 - RNA, 1617 nt, Artificial Sequence
  derived and/or modified sequence opt1 from VP1__Norovirus_and/or_Norovirus-like__KY486271
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccgggccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcuccaccacgcaccgcaacgagccccagcagugggugcugcccagcuacuccgggcggaacacccacaacgugcaccucgcgccggccgucgcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgguga

SEQ ID NO: 12208 - RNA, 1617 nt, Artificial Sequence
  derived and/or modified sequence opt1 from VP1__Norovirus_and/or_Norovirus-like__KP784692
augaagauggccagcuccgacgccaaccccagcgacggcuccaccgcgaaccuggugccggaggucaacaacgaggugauggcccucgagcccguggucggggccgcccuggccgcgcccguggccggccagcagaacgugaucgaccccuggauccgcagcaacuucguccaggcccccgggggcgaguucaccgugagcccccggaacgcccccggggagauccugugguccgcgccccucggcccggaccugaaccccuaccugucccaccucgcccgcauguacaacggcuacgccgggggcuucgaggugcaggucauccuggccgggaacgccuucacggcgggcaaggugaucuucgccgccgugccgcccaacuucccgaccgaggggcugagccccucccaggucaccauguucccccacaucaucguggacgugcggcagcucgagcccguccugaucccgcugcccgacgugcgcaacaacuucuaccacuacaaccagagcaacgaguccaccaucaagcucaucgccaugcuguacacgccccugcgggccaacaacgcgggcgacgacguguucaccgucagcugccgcgugcucacccggcccuccccggacuucgacuucaucuuccuggugccgcccaccgucgagagccgcacgaagcccuucuccgugcccauccugaccguggaggagaugaccaacagccgguuccccaucccccucgagcgccuguucaccggccccuccagcgccuucgucgugcagccgcagaacgggcggugcacgaccgacggcguccugcucgggaccacccagcugucccccgugaacaucugcacguuccgcggcgacgugacccacaccaccggcagccacaacuacacgaugaaccuggccagccagaacugguccaacuacgaccccaccgaggagaucccggcgccccucgggacccccgacuucgucggcaagauccagggggugcugacccagacgacccgggccgacggcagcacccgcgggcacaaggccaccguguacacgggcuccgccgacuucacccccaagcugggccggguccaguucgccaccgacaccgaccacgacuucgacacgaaccagaacaccaaguucaccccggugggggugauccaggacggcagcaccacgcaccgcaacgagccccagcaguggguccuccccuccuacagcgggcggaacacccacaacgugcaccuggcccccgccguggcgccgaccuuccccggcgagcagcuccuguucuuccgcuccaccaugcccgggugcagcggcuaccccaacauggaccuggacugccugcucccgcaggagugggucgcccacuucuaccaggaggccgcccccgcgcaguccgacguggcccugcugcgguucgugaaccccgacaccggccgcguccucuucgagugcaagcugcacaagagcggguacgugacgguggcccacaccggccagcacgaccuggucaucccgcccaacggguacuuccgguucgacuccugggugaaccaguucuacacccucgcccccaugggcaacgggaccggccgccgccgguga

SEQ ID NO: 12209 - RNA, 1617 nt, Artificial Sequence
  derived and/or modified sequence opt1 from VP1__Norovirus_and/or_Norovirus-like__KX371604
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcugccguccuacagcgggcggaacauccacaacgugcaccucgcccccgccaucgcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12210 - RNA, 1617 nt, Artificial Sequence
  derived and/or modified sequence opt1 from VP1__Norovirus_and/or_Norovirus-like__KX354079
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagguccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucguggccaaccagaacaccaaguucacccccgucggggugauccaggacggcagcacgacgccccgcaacgagccccagcagugggugcugccguccuacagcgggcggaacacccacaacguccaccucgcccccgccguggcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcagcgggacgggccgccgccgguga

SEQ ID NO: 12211 - RNA, 1617 nt, Artificial Sequence
  derived and/or modified sequence opt1 from VP1__Norovirus_and/or_Norovirus-like__KX354028
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagacgcccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacacccacaacguccaccucgccccggcgguggcccccacguuccccggcgagcagcugcuguucuuccgcagcaccaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 12212 - RNA, 1617 nt, Artificial Sequence
  derived and/or modified sequence opt1 from VP1__Norovirus_and/or_Norovirus-like__KX353983
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgguga

SEQ ID NO: 12213 - RNA, 1617 nt, Artificial Sequence
  derived and/or modified sequence opt1 from VP1__Norovirus_and/or_Norovirus-like__AB972511
augaagauggccagcaacgacgccaaccccuccgacggcccggcggccaaccuggugcccgaggucaacaacgaggugauggcccucgagcccguggucggggccgccaucgcggcccccguggccggccagcagaacgugaucgacccguggauccgcaacaacuucguccaggcccccgggggcgaguucaccgugagcccccggaacgcgcccggggagauccugugguccgccccgcugggccccgaccucaaccccuaccugagccaccuggcccgcauguacaacggcuacgccgggggcuucgaggugcaggucauccucgccgggaacgcguucaccgccggcaagaucaucuucgccgccgugcccccgaacuuccccacggaggggcugucccccagccaggugaccauguucccccacaucaucgucgacgugcggcagcuggagccggugcucaucccccugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggaugcugacccagaccaccaagggcgacgggagcacgcggggccacaaggccaccgucuacaccggcuccgccccguucacccccaagcuggggagcgugcaguucgagacggacaccgagaacgacuucgagacccaccagaacaccaaguucacgcccgugggcgucauccaggacgggggcaccacccaccgcaacgagccccagcagugggugcucccgagcuacuccgggcggaacgugcccaacguccaccuggcccccgccguggcgcccaccuucccgggcgagcagcuccucuucuuccgcagcaucaugcccggcugcuccggguaccccaacauggaccuggacugccugcucccccaggagugggugcagcacuucuaccaggaggccgccccggcccagagcgacgucgcgcugcugcgguucgugaaccccgacacgggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcaccgggcgccggcgcuga

SEQ ID NO: 12214 - RNA, 1617 nt, Artificial Sequence
  derived and/or modified sequence opt1 from VP1__Norovirus_and/or_Norovirus-like__AB972478
augaagauggccagcuccgacgccaaccccaccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaaggugaucuucgccgccgugccgcccaacuucccgaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcacgaagcccuucagcgugcccguccugaccguggaggagaugaccaacucccgguuccccaucccccuggagaagcuguucaccggcccgagcuccgccuucgucgugcagccccagaacgggcgcugcacgaccgacggcgugcuccuggggaccacccagcucagccccgucaacaucugcacguuccggggcgacgugacccacaucaccggcucccgcaacuacaccaugaaccuggccagccagaacugguccaacuacgacccgacggaggagauccccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacaccccgaacguccaccucgcccccgcgguggcccccacguuccccggcgagcagcugcuguucuuccgcagcaccaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 12215 - RNA, 1617 nt, Artificial Sequence
  derived and/or modified sequence opt1 from VP1__Norovirus_and/or_Norovirus-like__KT780382
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12216 - RNA, 1617 nt, Artificial Sequence
  derived and/or modified sequence opt1 from VP1__Norovirus_and/or_Norovirus-like__KT033905
augaagauggccagcaacgacgccaaccccuccgacggcagcgcggccaaccuggugccgaaggucaacaacgaggugauggcccucgagcccguggucggggccgccaucgcggcccccguggccggccagcagaacgugaucgaccccuggauccgcaacaacuucguccaggcccccgggggcaaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcuga

SEQ ID NO: 12217 - RNA, 1617 nt, Artificial Sequence
  derived and/or modified sequence opt1 from VP1__Norovirus_and/or_Norovirus-like__KR904207
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccacaacuacaccaugaaccuggccucccagaacuggaacagcuacgacccgacggaggagauccccgcgccccuggggacccccgacuucgugggcaagauccaggggguccucacccagaccacgcgcaccgacggcagcacccgggggcacaaggccaccguguacacgggcuccgccgacagcuccccgaagcugggccgcgugcaguucgccaccgacaccgacaacgacuucgucgccaaccagaacaccaaguucacgcccgugggggugauccaggacggcgggaccgcccaccggaacgagccccagcaguggguccugcccagcuacuccggccgcaacacccacaacgugcaccucgccccggcgguggcccccaccuuccccggggagcagcugcuguucuuccggagcacgaugcccggcugcuccggcuacccgaacauggaccucgacugccugcugccccaggaguggguccaguacuucuaccaggaggccgcccccgcgcagagcgacguggcccuccugcgcuucgugaaccccgacaccgggcggguccuguucgagugcaagcuccacaaguccggcuacgugacccaggcccacaccgggcagcacgaccuggugaucccgcccaacggcuacuuccgcuucgacagcugggucaaccaguucuacacccuggcccccauggggaacggcacgggccggcgccgcuga

SEQ ID NO: 12218 - RNA, 1617 nt, Artificial Sequence
  derived and/or modified sequence opt1 from VP1__Norovirus_and/or_Norovirus-like__KJ678151
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccacgccccuggagaagcuguucaccggcccguccagcgccuucgucgugcagccccagaacgggcgcugcaccaccgacggcgugcuccuggggaccacccagcucucccccgucaacaucugcacguuccggggcgacgugacccacaucaccggcagccgcaacuacaccaugaaccuggccucccagaacuggagcaacuacgacccgacggaggagauccccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccacgacuucgagaccaaccagaacacgaaguucacccccgucggggugauccaggacggcagcaccacccaccgcaacgagccccagcagugggugcugcccuccuacagcgggcggaacacgccgaacguccaccucgcccccgccguggcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacacgggccagcacgaccuggugaucccgcccaacggguacuuccgguucgacuccugggucaaccaguucuacacccuggcccccaugggcaacgggaccggccgccgccgguga

SEQ ID NO: 12219 - RNA, 1617 nt, Artificial Sequence
  derived and/or modified sequence opt1 from VP1__Norovirus_and/or_Norovirus-like__KJ678143
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccacgccccuggagaagcuguucaccggcccguccagcgccuucgucgugcagccccagaacgggcgcugcaccaccgacggcgugcuccuggggaccacccagcucucccccgucaacaucugcacguuccggggcgacgugacccacaucaccggcagccgcaacuacaccaugaaccuggccucccagaacuggagcaacuacgacccgacggaggagauccccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccacgacuucgaggccaaccagaacaccaaguucacgcccgucggggugauccaggacggcagcaccacccaccgcaacgagccccagcagugggugcugcccuccuacagcgggcggaacaccccgaacguccaccucgcccccgcgguggcccccacguuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgguga

SEQ ID NO: 12220 - RNA, 1617 nt, Artificial Sequence
  derived and/or modified sequence opt1 from VP1__Norovirus_and/or_Norovirus-like__KP698927
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgggaccaaccagaacaccaaguucacgcccgucggcgugauccaggacgggagcaccacccaccgcaacgagccccagcagugggugcugcccuccuacagcggccggaacaccccgaacguccaccucgcccccgccguggcgcccacguuccccggggagcagcugcuguucuuccgcuccaccaugccgggcugcagcggcuaccccaacauggaccucgacugccugcugccccaggagugggugcaguacuucuaccaggaggccgcccccgcccaguccgacgucgcgcuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgguga

SEQ ID NO: 12221 - RNA, 1617 nt, Artificial Sequence
  derived and/or modified sequence opt1 from VP1__Norovirus_and/or_Norovirus-like__LC005730
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12222 - RNA, 1617 nt, Artificial Sequence
  derived and/or modified sequence opt1 from VP1__Norovirus_and/or_Norovirus-like__LC005714
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcacccccuucacgccgaagcugggguccgugcaguucagcaccgacaccgagaacgacuucgagacccaccagaacacgaaguucacccccgugggcgucauccaggacggguccaccacccaccgcaacgagccccagcagugggugcuccccagcuacuccggccggaacgugccgaacguccaccuggcccccgccguggcccccacguuccccggggagcagcuccucuucuuccgcagcaccaugccgggcugcuccggcuaccccaacauggaccuggacugccugcucccccaggagugggugcagcacuucuaccaggaggcggcccccgcccagagcgacgucgcccugcugcgguucgugaacccggacaccgggcgcguccucuucgagugcaagcugcacaaguccggcuacgugaccguggcgcacaccgggcagcacgaccuggugaucccgcccaacggcuacuuccgguucgacagcugggucaaccaguucuacacgcucgcccccauggggaacggcaccggccgccggcgcuga

SEQ ID NO: 12223 - RNA, 1617 nt, Artificial Sequence
  derived and/or modified sequence opt1 from VP1__Norovirus_and/or_Norovirus-like__KP241906
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccaacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12224 - RNA, 1617 nt, Artificial Sequence
  derived and/or modified sequence opt1 from VP1__Norovirus_and/or_Norovirus-like__KM982938
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggccugcugcucgggaccacccagcugucccccgugaacaucugcaccuuccggggcgacgucacgcacaucaccggcagccgcaacuacaccaugaaccuggccucccagaacuggagcaacuacgacccgaccgaggagauccccgcgccccucgggacgcccgacuucgugggcaagauccagggggugcugacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcuccccagcuacuccggccggaacaccccgaacgugcaccuggcccccgcggucgcccccaccuuccccggggagcagcuccucuucuuccgcagcacgaugccgggcugcuccggcuaccccaacauggaccuggacugccugcucccccaggagugggugcaguacuucuaccaggaggccgcccccgcgcagagcgacguggcccugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccgccgguga

SEQ ID NO: 12225 - RNA, 1617 nt, Artificial Sequence
  derived and/or modified sequence opt1 from VP1__Norovirus_and/or_Norovirus-like__KM514058
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggccugcugcucgggaccacccagcugucccccgugaacaucugcaccuuccggggcgacgucacgcacaucaccggcagccgcaacuacaccaugaaccuggccucccagaacuggagcaacuacgacccgaccgaggagauccccgcgccccucgggacgcccgacuucgugggcaagauccagggggugcugacccagaccacccggacggacggcagcacccgcgggcacaaggccaccgucuacaccggcuccgccgacuucgccccgaagcugggccgggugcaguucgagacggacaccgaccgcgacuucgaggccaaccagaacaccaaguucacccccgugggggucauccaggacggcgggacgacccaccggaacgagccccagcagugggugcuccccagcuacuccggccgcaacaccccgaacgugcaccuggcccccgcggucgcccccaccuuccccggggagcagcuccucuucuuccggagcacgaugccgggcugcuccggcuaccccaacauggaccuggacugccugcucccccaggagugggugcaguacuucuaccaggaggccgcccccgcgcagagcgacguggcccugcugcgcuucgucaacccggacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccgccggcgcuga

SEQ ID NO: 12226 - RNA, 1617 nt, Artificial Sequence
  derived and/or modified sequence opt1 from VP1__Norovirus_and/or_Norovirus-like__KM198580
augaagauggccagcaacgacgccaaccccaccgacggcuccgcggccaaccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagaccaacgacagcacgaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucaccguccccauccugaccguggaggagaugacgaacagccgguuccccaucccccuggagaagcuguucaccggccccuccggggccuucgugguccagccgcagaacggccgcugcaccaccgacggggugcugcugggcacgacccagcucagccccgucaacaucugcaccuuccggggcgacgugacccacaucgccgggucccgcaacuacacgaugaaccuggccagccugaacuggaacaacuacgaccccaccgaggagaucccggcgccccucggcacccccgacuucguggggaagauccagggcguccugacccagacgaccaagggggacggcuccacccggggccacaaggccaccguguacacggggagcgcccccuucaccccgaagcugggcuccgugcaguucagcaccgacaccgagaacgacuucgagacgcaccagaacaccaaguucacccccgucggggugauccaggacggcgggaccacgcaccgcaacgagccccagcagugggugcuccccagcuacuccggccgggacguccacaacgugcaccuggccccggccguggcgcccaccuuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacacggggcagcacgaccuggucaucccgcccaacggcuacuuccgguucgacagcugggugaaccaguucuacacccucgcccccaugggcaacgggaccggccgccggcgcuga

SEQ ID NO: 12227 - RNA, 1617 nt, Artificial Sequence
  derived and/or modified sequence opt1 from VP1__Norovirus_and/or_Norovirus-like__KM198537
augaagauggcccccaacgacgccaaccccagcgacggcuccgcggccaaccuggugcccgaggucagcaacgaggugauggcccucgagcccguggucggggccgccaucgcggcccccguggccggccagcagaacgugaucgacccguggauccgcaacaacuucguccaggcccccgggggcgaguucaccgugagcccccggaacgcgcccggggagauccuguggggcgccccgcugggccccgaccucaaccccuaccugucccaccuggcccgcauguacaacggguacgccggcggguucgaggugcaggucauccucgccggcaacgcguucaccgccgggaagaucaucuucgccgccgugcccccgaacuuccccacggagggccugucccccagccaggugaccauguucccccacaucaucgucgacgugcggcagcuggagccggugcucaucccccugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacggggccgagcggcgccuucgugguccagccccagaacgggcgcugcaccaccgacggcgugcugcugggcaccacgcagcucucccccgucaacaucugcaccuuccgcggggacgugacccacaucgccggcagccggaacuacaccaugaaccuggccucccugaacuggaacaacuacgacccgacggaggagauccccgcgccccucgggacccccgacuucgugggcaagauccaggggguccugacccagaccacgaagggcgacggcagcacccgggggcacaaggccaccguguacaccggcuccgccccguucacgcccaagcuggggagcgugcaguucuccaccgacaccgagaacgacuucgagacccaccagaacacgaaguucacccccgucggcgugauccaggacgggggcaccacccaccgcaacgagccccagcagugggugcucccgagcuacagcggccgggacguccacaacgugcaccuggcccccgccguggcgcccacguuccccggggagcagcuccucuucuuccgcuccaccaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaacggccagcacgaccuggucaucccgcccaacggcuacuuccgguucgacuccugggugaaccaguucuacacccucgcccccauggggaacggcacggggcgccggcgcuga

SEQ ID NO: 12228 - RNA, 1617 nt, Artificial Sequence
  derived and/or modified sequence opt1 from VP1__Norovirus_and/or_Norovirus-like__KF177450
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugaucccccaggagugggugcaguacuucuaccaggaggccgcccccgcgcaguccgacgucgcccugcuccgguucgugaaccccgacaccgggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccauggggaacggcacgggccgccgccgguga

SEQ ID NO: 12229 - RNA, 1617 nt, Artificial Sequence
  derived and/or modified sequence opt1 from VP1__Norovirus_and/or_Norovirus-like__KF008243
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcacggacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacacccacaacguccaccucgccccggccguggcgcccacguuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 12230 - RNA, 1617 nt, Artificial Sequence
  derived and/or modified sequence opt1 from VP1__Norovirus_and/or_Norovirus-like__KF429782
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagccccuccugaucccgcugcccgacgugcgcaacaacuucuaccacuacaaccaguccaacgaccccaccaucaagcucaucgccaugcuguacacgccccugcgggccaacaacgcgggcgacgacgucuucaccgugagcugccgcgugcucacccggccgucccccgacuucgacuucaucuuccuggucccgcccaccguggagagccgcacgaagcccuucuccgugcccauccugaccaucgaggagaugaccaacagccgguuccccaucccccucgagaagcuguucaccggcccguccagcgccuucgucgugcagccccagaacgggcgcugcacgaccgacggcgugcugcucgggaccacccagcugucccccgucaacaucugcacguuccggggcgacgugacccacaucaccggcacccacaacuacgccaugaaccuggccgcccagaacuggaacagcuacgacccgacggaggagauccccgcgccccucgggacccccgacuucgucggcaagauccagggggugcugacccagaccacgcgcgccgacggcuccacccgggcccacaaggccaccguguacaccgggagcgccgaguucgcgccgaagcugggccgcguccaguucgccacggacaccgacagcgacuucgacaccaaccagaacaccaaguucacgcccgugggcgugauccaggacgggaacaccgcccaccagaacgagccccagcaguggguccuccccuccuacagcggccggaacaaccacaacgugcaccuggccccggcgguggcccccaccuuccccggggagcagcuccuguucuuccgcuccaccaugcccggcugcagcggguacccgaacaugaaccuggacugccugcucccccaggaguggguccaguacuucuaccaggaggccgcccccgcccaguccgacguggcgcugcugcgguucgugaaccccgacacgggccgcguccucuucgagugcaagcugcacaagagcggcuacgugaccguggcccacaccgggcagcacgaccuggucaucccgcccaacggcuacuuccgguucgacuccugggugagccccuucuacacccucgcccccauggggaacggcaccgggcgccggcgcuga

SEQ ID NO: 12231 - RNA, 1617 nt, Artificial Sequence
  derived and/or modified sequence opt1 from VP1__Norovirus_and/or_Norovirus-like__KF060101
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccgggccgacggcuccacgcgcgggcacaaggccaccguguacaccggcagcgccgacuucuccccgaagcugggccggguccaguucgccaccgacacggacaacgacuucguggccaaccagaacaccaaguucacccccgugggggucauccaggacggcagcaccacgccccgcaacgagccccagcagugggugcugccguccuacagcgggcggaacacccacaacgugcaccucgcccccgcggucgcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacguggcccuccugcgguucgucaacccggacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgguga

SEQ ID NO: 12232 - RNA, 1617 nt, Artificial Sequence
  derived and/or modified sequence opt1 from VP1__Norovirus_and/or_Norovirus-like__KF060096
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccguguucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgcgguggcccccaccuuccccggcgagcagcugcuguucuuccgcuccacgaugccggggugcagcggcuaccccaacauggaccucgacugccugcugccccaggaguggguccaguacuucuaccaggaggccgcccccgcgcaguccgacguggcccuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12233 - RNA, 1617 nt, Artificial Sequence
  derived and/or modified sequence opt1 from VP1__Norovirus_and/or_Norovirus-like__KF060071
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggucagccagaacuggaacagcuacgacccgaccgaggagauccccgcgccccuggggacgcccgacuucgugggcaagauccagggggugcucacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcugccguccuacagcgggcggaacauccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcgcccaugggcaacgggacgggccgccgccgguga

SEQ ID NO: 12234 - RNA, 1617 nt, Artificial Sequence
  derived and/or modified sequence opt1 from VP1__Norovirus_and/or_Norovirus-like__KF060056
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgccaccgucgcccacaccgggcagcacgaccuggugaucccgcccaacggcuacuuccgguucgacuccugggugaaccaguucuacacccuggcccccauggggaacggcacgggccgccgccgguga

SEQ ID NO: 12235 - RNA, 1617 nt, Artificial Sequence
  derived and/or modified sequence opt1 from VP1__Norovirus_and/or_Norovirus-like__JX439836
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgagccugggccccgaccucaacccguaccugucccaccuggcccgcauguacaacggcuacgccgggggcuucgaggugcaggucauccucgccgggaacgccuucacggcgggcaagaucaucuucgccgccgugccgcccaacuuccccaccgaggggcugagcccgucccaggugaccauguucccccacaucaucgucgacgugcggcagcuggagcccgugcucaucccccugccggacguccgcaacaacuucuaccacuacaaccagagcaacgaccccaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12236 - RNA, 1617 nt, Artificial Sequence
  derived and/or modified sequence opt1 from VP1__Norovirus_and/or_Norovirus-like__HF952129
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucccgggcagccacaacuacaccaugaaccuggccucccagaacuggaacagcuacgaccccaccgaggagauccccgcgccccuggggacgccggacuucgugggcaagauccaggggguccucacccagaccacccgcacgaacggcagcacccgggggcacaaggccaccguguacaccggcuccgccgacuucagccccaagcugggccgcgugcaguucgccacggacaccgacaacgacuucgagaccaaccagaacaccaaguucacgcccgucggggugauccaggacggcuccaccacgccccggaacgagccgcagcagugggugcugcccagcuacuccgggcgcaacauccacaacguccaccucgcccccgccguggcccccaccuucccgggcgagcagcugcuguucuuccggagcaccaugcccgggugcuccggcuaccccaacauggaccucgacugccugcugccccaggagugggugcaguacuucuaccaggaggcggccccggcccagagcgacgucgcccuccugcgcuucgugaaccccgacaccggccgggugcuguucgagugcaagcuccacaaguccggguacgucaccguggcgcacaccggccagcacgaccuggugaucccgcccaacggguacuuccgcuucgacagcugggucaaccaguucuacacccuggcccccaugggcaacgggacgggccggcgccgcuga

SEQ ID NO: 12237 - RNA, 1617 nt, Artificial Sequence
  derived and/or modified sequence opt1 from VP1__Norovirus_and/or_Norovirus-like__KC409273
augaagauggccagcaacgacgccaaccccuccgacggcagcgcggccucccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagaccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccggggccuucgugguccagccgcagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcagcgugcaguucuccaccgacaccgagaacgacuucgagacccaccagaacacgaaguucacccccgucggggugauccaggacggcgggaccacccaccgcaacgagccccagcagugggugcuccccagcuacuccggccgggacguccacaacgugcaccuggccccggccguggcgcccacguuccccggcgagcagcuccucuucuuccgcagcaccaugcccgggugcuccggcuacccgaacauggaccuggacugccugcucccccaggaguggguccagcacuucuaccaggaggccgcccccgcccagagcgacgcggcccugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacgcucgcccccaugggcaacgggaccggccgccggcgcuga

SEQ ID NO: 12238 - RNA, 1617 nt, Artificial Sequence
  derived and/or modified sequence opt1 from VP1__Norovirus_and/or_Norovirus-like__KC409242
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12239 - RNA, 1617 nt, Artificial Sequence
  derived and/or modified sequence opt1 from VP1__Norovirus_and/or_Norovirus-like__JX445167
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccacaacuacaccaugaaccuggccucccagaacuggaacagcuacgaccccaccgaggagguccccgcgccccuggggacgccggacuucgugggcaagauccagggggugcucacccagaccacccgcacgaacggcagcacccgggggcacaaggccaccgucuacaccggcuccgccgacuucagccccaagcugggccgcgugcaguucgccacggacaccaacaacgacuucgagaccaaccagaacaccaaguucacgcccgugggggucauccaggacggcuccaccacgccccggaacgagccgcagcagugggugcugcccagcuacuccgggcgcaacacccacaacgugcaccucgcccccgccgucgcccccaccuucccgggcgagcagcugcuguucuuccggagcaccaugcccgggugcuccggcuaccccaacauggaccucgacugccugcugccccaggagugggugcaguacuucuaccaggaggcggccccggcccagagcgacguggcccuccugcgcuucgucaaccccgacaccggccgggugcuguucgagugcaagcuccacaaguccggguacgugaccgucgcgcacaccggccagcacgaccuggugaucccgcccaacggguacuuccgcuucgacagcugggugaaccaguucuacacgcuggcccccaugggcaacgggaccggccggcgccgcuga

SEQ ID NO: 12240 - RNA, 1617 nt, Artificial Sequence
  derived and/or modified sequence opt1 from VP1__Norovirus_and/or_Norovirus-like__JX445156
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugggggccaacaacgcgggcgacgacguguucaccguguccugccggguccugacccgcccgagccccgacuucgacuucaucuuccucgugccgcccaccguggagucccggacgaagcccuucagcguccccauccugaccguggaggagaugaccaacucccgcuuccccaucccccuggagaagcuguucaccggcccgagcuccgccuucgugguccagccccagaacgggcggugcacgaccgacggcgugcuccuggggaccacccagcucagccccgucaacaucugcacguuccgcggcgacgugacccacaucgccggcacccaggaguacaccaugaaccuggccucccagaacuggaacaacuacgacccgacggaggagauccccgcgccccuggggacccccgacuucgugggcaagauccaggggguccucacccagaccacgcggcgcgacggcagcacccgggggcacaaggccaccgugagcaccggcuccgugcacuucacgccgaagcugggccgcauccaguucagcaccgacaccuccaacgacuucgagaccgggcagaacacgcgguucacccccgucggcguggugcaggacgggagcaccacccaccagaacgagccccagcaguggguccugcccaacuacuccggccgcgacagccacaacgugcaccucgccccggccguggcccccuccuuccccggggagcagcugcuguucuuccggagcacgaugcccggcugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccauggggaacggcacgggccggcgccgcuga

SEQ ID NO: 12241 - RNA, 1617 nt, Artificial Sequence
  derived and/or modified sequence opt1 from VP1__Norovirus_and/or_Norovirus-like__GQ856458
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgcccugaccgccggcaagaucaucuucgccgccgugccgcccaacuucccgacggaggggcugagccccucccaggugaccauguucccccacaucaucgucgacgugcggcagcucgagcccgugcugaucccgcugcccgacguccgcaacaacuucuaccacuacaaccagagcaacgacuccaccaucaagcucaucgccaugcuguacacgccccugcgggcgaacaacgccggcgaggacguguucaccgugagcugccgcguccucacccggcccuccccggacuucgacuucaucuuccuggugccgcccaccguggagagccgcaccaagcccuucacgguccccauccugaccguggaggagaugaccaacucccgguuccccaucccccucgagaagcuguucaccggccccagcuccgccuucgugguccagccgcagaacgggcgcugcacgaccgacggcgugcugcucgggaccacccagcugagccccgucaacaucugcacguuccggggcgacgugacccacaucgccggcucccgcaacuacaccaugaaccuggccagccucaacuggaacaacuacgaccccaccgaggagaucccggcgccccuggggacgcccgacuucgugggcaagauccaggggguccccacccagaccaccaagggcgacggguccacgcggggccacaaggccaccguguacaccggcagcgccccguucacccccaagcuggggagcgugcaguucuccacggacaccgagaacgacuucgaggcccaccagaacaccaaguucacccccgucggcgugauccaggacgggggcacgacccaccgcaacgagccccagcagugggugcucccgagcuacuccgggcggaacguccccaacgugcaccuggcccccgcgguggcccccaccuucccgggcgagcagcuccuguucuuccgcagcaccaugcccggcugcuccggguaccccaacauggaccuggacugccugcucccccaggaguggguccagcacuucuaccaggaggccgccccggcgcagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcuga

SEQ ID NO: 12242 - RNA, 1617 nt, Artificial Sequence
  derived and/or modified sequence opt1 from VP1__Norovirus_and/or_Norovirus-like__AB541299
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcacagccuguacuuccgcuccacgaugccgggcugcagcggguaccccaacauggaccucgacugccugcugccccaggaguggguccagcacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggcacggggcgccggcgcuga

SEQ ID NO: 12243 - RNA, 1617 nt, Artificial Sequence
  derived and/or modified sequence opt1 from VP1__Norovirus_and/or_Norovirus-like__AB541195
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcaugcugacccagaccaccaagggggacggcuccacgcggggccacaaggccaccgucuacaccgggagcgcccccuucaccccgaagcugggcaacgugcaguucagcacggacaccgagaacgacuucgagacccaccagaacaccaaguucacgcccgugggggucauccaggacggcuccaccacccaccgcaacgagccccagcagugggugcuccccagcuacuccgggcgggacgugcacaacguccaccuggccccggccguggcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcuga

SEQ ID NO: 12244 - RNA, 1617 nt, Artificial Sequence
  derived and/or modified sequence opt1 from VP1__Norovirus_and/or_Norovirus-like__AB504322
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagcugaacgacagcaccaucaagcucaucgccaugcuguacacgccccugcgggcgaacaacgccggcgaggacguguucaccguguccugccgcguccucacccggcccagcccggacuucgacuucaucuuccuggugccgcccaccguggagucccgcaccaagcccuucacgguccccauccugaccguggaggagaugaccaacagccgguuccccaucccccucgagaagcuguucaccggccccuccggggccuucgugguccagccgcagaacggccgcugcacgaccgacggggugcugcucggcaccacccagcugagccccgucaacaucugcacguuccggggcgacgugacccacaucgccgggucccgcaacuacaccaugaaccuggccagccucaacuggaacaacuacgaccccaccgaggagaucccggcgccccugggcacgcccggguucgugggcaagauccaggggguccugacccagaccaccaagggcgacggcuccacgcgggggcacaaggccaccguguacaccggcagcgcccccuucaccccgaagcucggguccgugcaguucagcacggacaccgagaacgacuucgagacccaccagaacaccaaguucacgcccgucggcgugauccaggacgggagcaccacccaccgcaacgagccccagcagugggugcugcccuccuacagcggccggaacguccacaacgugcaccuggccccggccguggcgcccaccuuccccggcgagcagcuccuguucuuccgcuccacgaugcccgggugcagcggcuacccgaacauggaccuggacugccuccugccccaggaguggguccagcacuucuaccaggaggccgcccccgcccaguccgacguggcgcugcuccgguucgugaaccccgacaccgggcgcguccuguucgagugcaagcugcacaagagcggcuacgugaccguggcccacaccgggcagcacgaccucgucaucccgcccaacggcuacuuccgguucgacuccugggugaaccaguucuacacccuggcccccaugggcaacgggacgggccgccggcgcuga

SEQ ID NO: 12245 - RNA, 1617 nt, Artificial Sequence
  derived and/or modified sequence opt1 from VP1__Norovirus_and/or_Norovirus-like__EU876892
augaagauggccagcaacgacgccaaccccuccgacggcagcgcggccaaccuggugcucgaggucaacaacgaggugauggcccuggagccgguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccucggccccgaccugaacccguaccugucccaccucgcccgcauguacaacggcuacgccgggggcuucgaggugcaggucauccuggccgggaacgccuucaccgccggcaagaucaucuucgccgccgugccgcccaacuuccccacggaggggcugagccccucccaggugaccauguucccccacaucaucgucgacgugcggcagcucgagcccgugcugaucccccugccggacguccgcaacaacuucuaccacuacaaccagagcaacgacuccaccaucaagcucaucgccaugcuguacacgccccugcgggcgaacaacgccggcgaggacguguucaccgugagcugccgcguccucacccggcccucccccgacuucgacuucaucuuccuggugccgcccaccguggagagccgcaccaagcccuucacgguccccauccugaccguggaggagaugaccaacucccgguucccgaucccccucgagaagcuguucaccggccccagcggggccuucgugguccagccccagaacggccgcugcacgaccgacggggugcugcucggcaccacccagcuguccccggucaacaucugcacguuccggggcgacgugacccacaucgccgggagccgcaacuacaccaugaaccuggccucccucaacuggaacaacuacgaccccaccgaggagauccccgcgccgcugggcacgcccgacuucguggggaagauccagggcguccugacccagaccaccaagggggacggcagcacgcggggccacaaggccaccguguacaccggguccgcccccuucacccccaagcucggcagcgugcaguucagcacggacaccgagaacgacuucgagacccaccagaacaccaaguucacgccggucggggugauccaggacggcuccaccacccaccgcaacgagccccagcagugggugcugcccagcuacuccgggcggaacguccacaacgugcaccuggcccccgccguggcgccgaccuuccccggcgagcagcuccuguucuuccgcagcacgaugcccggcugcuccggguaccccaacauggaccuggacugccuccugccgcaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcacggggcgccggcgcuga

SEQ ID NO: 12246 - RNA, 1617 nt, Artificial Sequence
  derived and/or modified sequence opt1 from VP1__Norovirus_and/or_Norovirus-like__EU876891
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggagaagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcuga

SEQ ID NO: 12247 - RNA, 1617 nt, Artificial Sequence
  derived and/or modified sequence opt1 from VP1__Norovirus_and/or_Norovirus-like__AB294792
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgacgugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccacccaccgcaacgagccccagcagugggugcugcccgacuacagcgggcggacgguccacaacgugcaccucgccccggccguggcccccaccuuccccggcgagcagcugcuguucuuccgcuccaccaugcccggcugcagcggguacccgaacauggaccucgacugccugcugccccaggaguggguccagcacuucuaccaggaggccgcgcccucccagagcgacguggcccuccugcgguucgugaaccccgacaccggccgcguccuguucgagugcaagcuccacaaggccggguacgugaccguggcccacacgggccagcacgaccuggucaucccgcccaacggguacuuccgguucgacuccugggugaaccaguucuacacccuggcgcccaugggcaacggcgccgggcgccgccgguga

SEQ ID NO: 12248 - RNA, 1617 nt, Artificial Sequence
  derived and/or modified sequence opt1 from VP1__Norovirus_and/or_Norovirus-like__AB303932
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcgugcaguucaacaccgacaccaacaacgacuucgagacggggcagaacacccgguucacccccgucggcguggugcaggacgggaacggcacccaccagaacgagccccagcaguggguccugcccuccuacagcggccgcacggggcacaacgugcaccucgccccggccguggcccccaccuuccccggcgagcagcugcuguucuuccggagcaccaugcccgggugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacacgggccagcacgaccuggucaucccgcccaacggguacuuccgcuucgacagcugggugaaccaguucuacacccuggcgcccaugggcaacgggaccggccggcgccgcuga

SEQ ID NO: 12249 - RNA, 1617 nt, Artificial Sequence
  derived and/or modified sequence opt1 from VP1__Norovirus_and/or_Norovirus-like__LC177660
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaagcugggguacgugaccgucgcccacaccggccagcacgaccuggugaucccgcccaacggguacuuccgguucgacuccugggugaaccaguucuacacccucgcccccaugggcaacgggacgggccgccgccgguga

SEQ ID NO: 12250 - RNA, 1617 nt, Artificial Sequence
  derived and/or modified sequence opt1 from VP1__Norovirus_and/or_Norovirus-like__KX608866
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucguggccaaccagaacaccaaguucacccccgugggggucauccaggacggcagcacgacgccccgcaacgagccccagcagugggugcugccguccuacagcgggcggaacacccacaacgugcaccucgcccccgccgucgcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacguggcgcuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 12251 - RNA, 1617 nt, Artificial Sequence
  derived and/or modified sequence opt1 from VP1__Norovirus_and/or_Norovirus-like__KX371603
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12252 - RNA, 1617 nt, Artificial Sequence
  derived and/or modified sequence opt1 from VP1__Norovirus_and/or_Norovirus-like__KX354086
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgccacggacaccaacgacgacuucgagaccaaccagaacaccaaguucacgcccgucggggugauccaggacggcuccaccacgccccgcaacgagccccagcagugggugcugccgagcuacuccgggcggaacacccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacgucaccguggcgcacaccggccagcacgaccuggugaucccgcccaacggguacuuccgguucgacagcugggucaaccaguucuacacgcuggcccccaugggcaacgggaccggccgccggcgcuga

SEQ ID NO: 12253 - RNA, 1617 nt, Artificial Sequence
  derived and/or modified sequence opt1 from VP1__Norovirus_and/or_Norovirus-like__KX354080
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacgggaccggccgccgccgguga

SEQ ID NO: 12254 - RNA, 1617 nt, Artificial Sequence
  derived and/or modified sequence opt1 from VP1__Norovirus_and/or_Norovirus-like__KX354054
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12255 - RNA, 1617 nt, Artificial Sequence
  derived and/or modified sequence opt1 from VP1__Norovirus_and/or_Norovirus-like__KX354041
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucucccugcccguccugaccguggaggagaugaccaacagccgguuccccaucccccucgagaagcuguucaccggcccguccagcgccuucgugguccagccccagaacgggcgcugcacgaccgacggcgugcugcucgggaccacccagcugucccccgucaacaucugcacguuccggggcgacgugacccacaucagcggcucccgcaacuacaccaugaaccuggccagccagaacuggaacagcuacgacccgaccgaggagauccccgcgccccucgggacgcccgacuucgugggcaagauccaggggguccugacccagaccacccggacgaacggcuccacccgcgggcacaaggccaccguguacaccggcagcguggacuucuccccgaagcugggccggguccaguucgccacggacaccgacaacgacuucgagaccaaccagaacaccaaguucacgcccgugggggugauccaggacggcagcaccacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggccgcgcccgcccaguccgacguggcccugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcgcccaugggcaacgggacgggccgccgccgguga

SEQ ID NO: 12256 - RNA, 1617 nt, Artificial Sequence
  derived and/or modified sequence opt1 from VP1__Norovirus_and/or_Norovirus-like__KX354029
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagacgcccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacacccacaacguccaccucgccccggcgguggcccccacguuccccggcgagcagcugcuguucuuccgcagcaccaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggccuacaccggccagcacgaccuggugaucccgcccaacggguacuuccgguucgacagcugggucaaccaguucuacacgcuggcccccaugggcaacgggaccggccgccgccgguga

SEQ ID NO: 12257 - RNA, 1617 nt, Artificial Sequence
  derived and/or modified sequence opt1 from VP1__Norovirus_and/or_Norovirus-like__KX353977
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacgccccgcaacgagccccagcaguggguccugccgagcuacuccggccggaacauccacaacgugcaccucgcccccgccguggcccccaccuuccccggggagcagcugcuguucuuccgcagcaccaugccgggcugcuccggcuaccccaacauggaccucgacugccugcugccccaggaguggguccaguacuucuaccaggaggcggcccccgcccagagcgacguggcccuccugcgguucgugaacccggacaccgggcgcguccuguucgagugcaagcuccacaaguccggcuacgugaccguggcgcacaccgggcagcacgaccuggucaucccgcccaacggcuacuuccgguucgacagcugggugaaccaguucuacacccuggcccccauggggaacggcacgggccgccgccgguga

SEQ ID NO: 12258 - RNA, 1617 nt, Artificial Sequence
  derived and/or modified sequence opt1 from VP1__Norovirus_and/or_Norovirus-like__KX353965
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaccccgggcagccacaacuacaccaugaaccuggccucccagaacuggaacagcuacgaccccacggaggagauccccgcgccccuggggaccccggacuucgucggcaagauccagggggugcucacccagaccacgcgcaccaacggcagcacccgggggcacaaggccaccguguacacgggcuccgccgacuucagccccaagcugggccgcguccaguucgccaccgacaccgacaacgacuucgagaccaaccagaacacgaaguucacccccgugggggugauccaggacggcuccaccacgccccggaacgagccgcagcaguggguccugcccagcuacuccgggcgcaacauccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacgcuggcccccaugggcaacgggaccggccggcgccgcuga

SEQ ID NO: 12259 - RNA, 1617 nt, Artificial Sequence
  derived and/or modified sequence opt1 from VP1__Norovirus_and/or_Norovirus-like__KU311158
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccgggccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccagcuacuccggccggaacaccccgaacguccaccucgcgcccgccguggcccccaccuuccccggggagcagcugcuguucuuccgcagcaccaugccgggcugcuccggcuaccccaacauggaccucgacugccugcugccccaggagugggugcaguacuucuaccaggaggccgcgcccgcccagagcgacgucgcccuccugcgguucgugaacccggacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccgccgguga

SEQ ID NO: 12260 - RNA, 1617 nt, Artificial Sequence
  derived and/or modified sequence opt1 from VP1__Norovirus_and/or_Norovirus-like__AB974408
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugaccacccccagcccggacuucgacuucaucuuccucgugccgcccaccguggagucccggacgaagcccuucaccguccccauccugaccguggaggagaugaccaacagccgcuuccccaucccccuggagaagcuguucacgggccccuccagcgccuucgugguccagccgcagaacgggcggugcaccaccgacggcgugcugcuggggaccacgcagcucucccccgucaacaucugcaccuuccgcggcgacgugacccacaucgccggcagccggaacuacaccaugaaccuggccucccugaacuggaacaacuacgaccccacggaggagaucccggcgccccucgggacccccgacuucgugggcaagauccaggggaugcugacccagaccacgaagggcgacgggagcacccgcggccacaaggccaccgucuacaccggcagcgcccccuucacgccgaagcugggguccgugcaguucagcaccgacaccgagaacgacuucgagacccaccagaacacgaaguucacccccgugggcgucauccaggacgggaacaccacccaccggaacgagccccagcagugggugcuccccuccuacagcggccgcaacgugccgaacguccaccuggcccccgccguggcgcccacguuccccggggagcagcuccucuucuuccgguccaccaugccgggcugcagcggcuaccccaacauggaccuggacugccugcucccccaggagugggugcagcacuucuaccaggaggccgcccccgcccaguccgacgucgcgcugcugcgcuucgugaacccggacaccgggcggguccucuucgagugcaagcugcacaagagcggcuacgugaccguggcccacaccgggcagcacgaccuggugaucccgcccaacggcuacuuccgcuucgacuccugggucaaccaguucuacacgcucgcccccauggggaacggcaccggccggcgccgguga

SEQ ID NO: 12261 - RNA, 1617 nt, Artificial Sequence
  derived and/or modified sequence opt1 from VP1__Norovirus_and/or_Norovirus-like__KR904221
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccgggccgacggcagcacccgcgggcacaaggccacggucuacaccggcagcgccgacuucgccccgaagcugggccgggugcaguucgagaccgacaccgaccacgacuucgaggcgaaccagaacacgaaguucacccccgugggggucauccaggacggcuccaccacccaccgcaacgagccccagcagugggugcugcccagcuacuccgggcggaacacgcacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugacggucgcccacaccggccagcacgaccuggugaucccgcccaacggguacuuccgguucgacagcugggugaaccaguucuacacccuggcgcccaugggcaacggggccggccgccgccgguga

SEQ ID NO: 12262 - RNA, 1617 nt, Artificial Sequence
  derived and/or modified sequence opt1 from VP1__Norovirus_and/or_Norovirus-like__AB933765
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgagccccugggcccggaccucaaccccuaccugagccaccuggcgcgcauguacaacggcuacgccgggggcuucgaggugcaggucauccucgccgggaacgccuucacggccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgccggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgcguucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacccaccgcaacgagccccagcaguggguccugcccagcuacuccggccggaacauccacaacgugcaccucgccccggccguggcccccaccuuccccggggagcagcugcuguucuuccgcagcacgaugcccggcugcuccggcuacccgaacauggaccucgacugccugcugccccaggaguggguccaguacuucuaccaggaggccgcgcccgcccagagcgacguggcccuccugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcgcccauggggaacggcacgggccgccgccgguga

SEQ ID NO: 12263 - RNA, 1617 nt, Artificial Sequence
  derived and/or modified sequence opt1 from VP1__Norovirus_and/or_Norovirus-like__AB933761
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaucaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12264 - RNA, 1617 nt, Artificial Sequence
  derived and/or modified sequence opt1 from VP1__Norovirus_and/or_Norovirus-like__AB933748
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccggcacgcugggccccgaccucaacccguaccugagccaccuggcgcgcauguacaacggguacgccggcggguucgaggugcaggucauccucgccggcaacgccuucaccgccgggaagaucaucuucgcggccgugccgcccaacuuccccaccgagggccuguccccgagccaggugaccauguucccccacaucaucgucgacgugcggcagcuggagcccgugcucaucccccugccggacguccgcaacaacuucuaccacuacaaccaguccaacgaccccacgaucaagcugaucgccaugcucuacacgccccugcgggccaacaacgccggcgacgacguguucaccgugagcugccgcguccugacccggcccuccccggacuucgacuucaucuuccucgugccgcccaccguggagagccgcaccaagcccuucuccguccccgugcugaccguggaggagaugaccaacagccgguuccccaucccccuggagaagcuguucacggggcccuccagcgcguucgucgugcagccgcagaacggccgcugcaccaccgacgggguccuccugggcaccacgcagcucucccccgugaacaucugcaccuuccggggcgacgugacccacauccccgggagccgcaacuacaccaugaaccuggccucccagaacuggaacagcuacgacccgacggaggagauccccgcgccccugggcacccccgacuucgucgggaagauccagggcgugcucacccagaccacgcggaccaacgggagcacccgcggccacaaggccaccguguacacgggcuccgccgacuucagcccgaagcuggggcggguccaguucgccaccgacaccgacaacgacuucgagaccaaccagaacacgaaguucacccccgugggcgugauccaggacggguccaccacgccccgcaacgagccccagcaguggguccugccgagcuacuccggccggaacauccacaacgugcaccucgcccccgccguggcccccaccuuccccggggagcagcugcuguucuuccgcagcaccaugccgggcugcuccggcuaccccaacauggaccucgacugccugcugccccaggaguggguccaguacuucuaccaggaggccgcgcccgcccagagcgacguggcccuccugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacgcuggcgcccauggggaacggcaccggccgccgccgguga

SEQ ID NO: 12265 - RNA, 1617 nt, Artificial Sequence
  derived and/or modified sequence opt1 from VP1__Norovirus_and/or_Norovirus-like__EU921386
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugauccacaucgccgggucccgcaacuacaccaugaaccuggccagccugaacuggaacaacuacgaccccaccgaggagaucccggcgccccucggcacccccgacuucguggggaagauccagggcguccugacgcagaccaccaagggggacggcuccacccggggccacaaggccacgguguacaccgggagcgcccccuucaccccgaagcugggcagcgugcaguucuccaccgacacggagaacgacuucgaggcccaccagaacaccaaguucacccccgucggggugauccaggacggcgggaccacgcaccgcaacgagccccagcagugggugcuccccagcuacuccggccggaacguccacaacgugcaccuggccccggcgguggcccccaccuuccccggcgagcagcuccucuucuuccgcagcaccaugcccgggugcuccggcuacccgaacauggaccuggacugccugcucccccaggaguggguccagcacuucuaccaggaggccgcccccgcgcagagcgacguggcccugcugcgguucgugaaccccgacaccgggcgcguccucuucgagugcaagcugcacaaguccggcuacgugacgguggcccacaccgggcagcacgaccuggucaucccgcccaacggcuacuuccgguucgacagcugggugaaccaguucuacacccucgcccccaugggcaacgggaccggccgccggcgcuga

SEQ ID NO: 12266 - RNA, 1617 nt, Artificial Sequence
  derived and/or modified sequence opt1 from VP1__Norovirus_and/or_Norovirus-like__KP244321
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggaugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgguga

SEQ ID NO: 12267 - RNA, 1617 nt, Artificial Sequence
  derived and/or modified sequence opt1 from VP1__Norovirus_and/or_Norovirus-like__KP698923
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgaggccaaccagaacaccaaguucacccccgucggggugauccaggacggcgggacgacccaccggaacgagccccagcagugggugcugcccagcuacuccggccgcaacaccccgaacguccaccucgcccccgcggccgcccccaccuuccccggggagcagcugcuguucuuccggagcacgaugccgggcugcuccggcuaccccaacauggaccucgacugccugcugccccaggagugggugcaguacuucuaccaggaggccgcgcccgcccagagcgacguggcccuccugcgcuucgucaacccggacaccgggcgggugcuguucgagugcaagcuccacaaguccggcuacgugaccgucgcccacaccgggcagcacgaccuggugaucccgcccaacggcuacuuccgcuucgacagcugggugaaccaguucuacacccuggcccccauggggaacggcacgggccggcgccgcuga

SEQ ID NO: 12268 - RNA, 1617 nt, Artificial Sequence
  derived and/or modified sequence opt1 from VP1__Norovirus_and/or_Norovirus-like__KP241905
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaaggugaucuucgccgccgugccgcccaacuucccgacggaggggcugucccccagccaggucaccauguucccccacaucgugguggacguccgccagcuggagcccgugcucaucccgcugcccgacgugcggaacaacuucuaccacuacaaccaguccaacgaccccaccaucaagcugaucgccaugcucuacacgccccugcgcgcgaacaacgccggcgacgacgucuucaccgugagcugccgggugcugacccgcccgucccccgacuucgacuucaucuuccucgucccgcccaccguggagagccggaccaagcccuucuccgugcccauccugacggucgaggagaugaccaacagccgcuuccccaucccccuggagaagcuguucaccggcccguccagcgccuucgugguccagccccagaacgggcggugcaccacggacggcgugcuccuggggaccacccagcucucccccgugaacaucugcaccuuccgcggcgacgucacgcacaucaccggcagccggaacuacaccaugaaccuggccucccagaacuggagcaacuacgacccgaccgaggagauccccgcgccccuggggauccccgacuucgugggcaagauccaggggaugcucacgcagaccacccgcaccgacggcagcacgcgggggcacaaggccaccguguacaccggcuccgccgacuucgccccgaagcugggccgcguccaguucgagaccgacacggaccacgacuucgaggccaaccagaacaccaaguucacccccgugggggugauccaggacggcagcaccacgcaccggaacgagccccagcaguggguccugcccuccuacagcgggcgcaacaccccgaacgugcaccucgcccccgcgguggcccccaccuuccccggcgagcagcugcuguucuuccgguccaccaugccggggugcagcggcuaccccaacauggaccucgacugccugcugccccaggaguggguccaguacuucuaccaggaggccgcccccgcgcaguccgacguggcccuccugcgcuucgugaacccggacacgggccggguccuguucgagugcaagcuccacaagagcggguacgugaccguggcccacaccggccagcacgaccuggucaucccgcccaacggguacuuccgcuucgacuccugggugaaccaguucuacacccuggcccccaugggcaacgggaccggccgccggcgcuga

SEQ ID NO: 12269 - RNA, 1617 nt, Artificial Sequence
  derived and/or modified sequence opt1 from VP1__Norovirus_and/or_Norovirus-like__KP176393
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccuccauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 12270 - RNA, 1617 nt, Artificial Sequence
  derived and/or modified sequence opt1 from VP1__Norovirus_and/or_Norovirus-like__KP096330
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaagaccggcuacgucaccguggcccacaccgggcagcacgaccuggugaucccgcccaacggcuacuuccgguucgacuccugggucaaccaguucuacacgcuggcccccauggggaacggcaccggccgccgccgguga

SEQ ID NO: 12271 - RNA, 1617 nt, Artificial Sequence
  derived and/or modified sequence opt1 from VP1__Norovirus_and/or_Norovirus-like__KM982953
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccagaccaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcacgaagcccuucagcgugcccguccugaccguggaggagaugaccaacucccgguuccccaucccccuggagaagcuguucaccggcccgagcuccgccuucgucgugcagccccagaacgggcgcugcacgaccgacggcgugcuccuggggaccacccagcucagccccgucaacaucugcacguuccggggcgacgugacccacaucaccggcucccgcaacuacaccaugaaccuggccagccagaacuggaacaacuacgacccgacggaggagauccccgcgccccuggggauccccgacuucgugggcaagauccaggggaugcucacccagaccacccggacggacggcuccacccgcgggcacaaggccaccgucuacaccggcagcguggacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgccguggcgcccaccuuccccggcgagcagcugcuguucuuccgcuccacgaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 12272 - RNA, 1617 nt, Artificial Sequence
  derived and/or modified sequence opt1 from VP1__Norovirus_and/or_Norovirus-like__KM982936
augaagauggccagcuccgacgccaaccccagcgacggcuccgcggccaaccuggugcccgaggucaacaacgaggugcucgcccuggagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccauccugacggucgaggagaugaccaacagccgguuccccaucccccucgagaagcuguucaccggcccguccagcgccuucgugguccagccccagaacgggcgcugcaccacggacggcgugcugcucgggaccacccagcugucccccgugaacaucugcaccuuccggggcgacgucacgcacaucaccggcagccacaacuacaccaugaaccuggccucccagaacuggagcaacuacgacccgaccgaggagauccccgcgccccucgggacgcccgacuucgugggcaagauccagggggugcugacccagaccacccgcacggacggcagcacccgggggcacaaggccaccgucuacaccggcuccgccgacuucgccccgaagcugggccgcgugcaguucgagacggacaccgaccgggacuucgaggccaaccagaacaccaaguucacccccgugggggucauccaggacggcgggacgacccaccgcaacgagccccagcagugggugcuccccagcuacuccggccggaacaccccgaacgugcaccuggcccccgcggucgcccccaccuuccccggggagcagcuccuguucuuccgcagcacgaugccgggcugcuccggcuaccccaacauggaccuggacugccugcucccccaggagugggugcaguacuucuaccaggaggccgcccccgcgcagagcgacguggcccugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccgccgguga

SEQ ID NO: 12273 - RNA, 1617 nt, Artificial Sequence
  derived and/or modified sequence opt1 from VP1__Norovirus_and/or_Norovirus-like__KM514073
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagguccuccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccgcaacuacaccaugaaccuggccucccagaacuggagcaacuacgacccgaccgaggagauccccgcgccccucgggacgcccgacuucgugggcaagauccaggggaugcugacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcuccccuccuacagcgggcggaacaccccgaacgugcaccuggcccccgcggucgcccccaccuuccccggcgagcagcuccuguucuuccgcuccacgaugccggggugcagcggcuaccccaacauggaccuggacugccugcucccccaggagugggugcaguacuucuaccaggaggccgcccccgcgcaguccgacguggcccugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacgggacgggccgccgccgguga

SEQ ID NO: 12274 - RNA, 1617 nt, Artificial Sequence
  derived and/or modified sequence opt1 from VP1__Norovirus_and/or_Norovirus-like__KM268086
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcuggcccggccgucccccgacuucgacuucaucuuccucgucccgcccaccguggagagccgcaccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcgcccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 12275 - RNA, 1617 nt, Artificial Sequence
  derived and/or modified sequence opt1 from VP1__Norovirus_and/or_Norovirus-like__KM198552
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcuccugggcaccacgcagcucucccccgucaacaucugcaccuuccggggcgacgugacccacaucgccgggagccgcaacuacaccaugaaccuggccuccaucaacuggaacaacuacgaccccacggaggagaucccggcgccccugggcacccccgacuucguggggaagauccagggcguccucacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcugcccuccuacagcggccgggacguccacaacgugcaccucgccccggccguggcgcccacguuccccggcgagcagcugcuguucuuccgcuccaccaugcccgggugcagcggcuacccgaacauggaccucgacugccugcugccccaggaguggguccagcacuucuaccaggaggccgcccccgcccaguccgacgcggcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccaugggcaacgggaccggccgccggcgcuga

SEQ ID NO: 12276 - RNA, 1617 nt, Artificial Sequence
  derived and/or modified sequence opt1 from VP1__Norovirus_and/or_Norovirus-like__KJ716358
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgccgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcgcccgccguggcccccaccuuccccggcgagcagcugcuguucuuccgguccaucaugccggggugcagcggcuaccccaacauggaccucgacugccugcugccccaggagugggugcaguacuucuaccaggaggccgcgcccgcccaguccgacgucgcccuccugcgcuucgugaacccggacacgggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggaccggccgccggcgcuga

SEQ ID NO: 12277 - RNA, 1617 nt, Artificial Sequence
  derived and/or modified sequence opt1 from VP1__Norovirus_and/or_Norovirus-like__KJ649702
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccgcgacuucgaggccaaccagaacaccaaguucacccccgugggggucauccaggacggcagcacgacccaccggaacgagccccagcagugggugcugcccuccuacagcgggcgcaacaccccgaacgugcaccucgcccccgcggucgcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacguggcccuccugcgcuucgucaacccggacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacgggacgggccgccggcgcuga

SEQ ID NO: 12278 - RNA, 1617 nt, Artificial Sequence
  derived and/or modified sequence opt1 from VP1__Norovirus_and/or_Norovirus-like__KF429778
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucgccggcagccgcaacuacaccaugaaccuggccucccagaacuggaacagcuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcgggaccacgccccgcaacgagccccagcagugggugcugccguccuacagcggccggaacacccacaacgugcaccucgcccccgccgucgcgcccaccuuccccggggagcagcugcuguucuuccgcuccaccaugccgggcugcagcggcuaccccaacauggaccucgacugccugcugccccaggagugggugcaguacuucuaccaggaggccgcccccgcccaguccgacguggcgcuccugcgguucgucaacccggacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacgcuggcccccauggggaacggcaccggccgccgccgguga

SEQ ID NO: 12279 - RNA, 1617 nt, Artificial Sequence
  derived and/or modified sequence opt1 from VP1__Norovirus_and/or_Norovirus-like__KF060113
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcgccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcgcccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 12280 - RNA, 1617 nt, Artificial Sequence
  derived and/or modified sequence opt1 from VP1__Norovirus_and/or_Norovirus-like__KF060106
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgguga

SEQ ID NO: 12281 - RNA, 1617 nt, Artificial Sequence
  derived and/or modified sequence opt1 from VP1__Norovirus_and/or_Norovirus-like__KF060100
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccacaacuacaccaugaaccuggccagccagaacuggaacagcuacgacccgaccgaggagauccccgcgccccuggggacgcccgacuucgucggcaagauccaggggaugcucacccagaccacccgcacggacggcuccacccgggggcacaaggccaccguguacaccggcagcguggacuucuccccgaagcugggccgcguccaguucacgaccgacaccgacaacgacuucgagaccaaccagaacacgaaguucacccccgugggggugauccaggacggcagcaccacccaccggaacgagccccagcaguggguccugcccuccuacagcgggcgcaacacgcacaacgugcaccucgccccggccguggcccccaccuuccccggcgagcagcugcuguucuuccgguccaccaugcccgggugcagcggcuacccgaacauggaccucgacugccugcugccccaggaguggguccaguacuucuaccaggaggccgcccccgcgcaguccgacguggcccuccugcgcuucgugaaccccgacaccggccggguccuguucgagugcaagcuccacaagagcggguacgugaccguggcccacacgggccagcacgaccuggucaucccgcccaacggguacuuccgcuucgacuccugggugaaccaguucuacacccuggcccccaugggcaacgggaccggccggcgccgcuga

SEQ ID NO: 12282 - RNA, 1617 nt, Artificial Sequence
  derived and/or modified sequence opt1 from VP1__Norovirus_and/or_Norovirus-like__KF060069
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccacaacuacaccaugaaccuggccagccagaacuggaacagcuacgacccgaccgaggagauccccgcgccccuggggacgcccgacuucgucggcaagauccagggggugcucacccagaccacccgcacggacggcuccacccgggggcacaaggccaccguguacaccggcagcgccgacuucuccccgaagcugggccgcguccaguucgccacggacaccgacaacgacuucgugaccaaccagaacaccaaguucacgcccgugggggucauccaggacggcagcaccacgccccggaacgagccccagcagugggugcugccguccuacagcgggcgcaacacccacaacgugcaccucgcccccgccgucgcccccaccuuccccggcgagcagcugcuguucuuccgguccaccaugccggggugcagcggcuaccccaacauggaccucgacugccugcugccccaggagugggugcaguacuucuaccaggaggcggcccccgcccaguccgacguggcccuccugcgcuucgucaacccggacaccggccgggugcuguucgagugcaagcuccacaagagcggguacgugaccgucgcgcacaccggccagcacgaccuggugaucccgcccaacggguacuuccgcuucgacuccugggugaaccaguucuacacgcuggcccccaugggcaacgggaccggccggcgccgcuga

SEQ ID NO: 12283 - RNA, 1617 nt, Artificial Sequence
  derived and/or modified sequence opt1 from VP1__Norovirus_and/or_Norovirus-like__KF060055
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccuacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccacaacuacaccaugaaccuggccucccagaacuggaacagcuacgaccccaccgaggagauccccgcgccccuggggacgccggacuucgucggcaagauccagggggugcucacccagaccaccaagacgaacggcagcacccgcgggcacaaggccaccguguacaccggcuccgccgacuucagccccaagcugggccggguccaguucgccacggacaccaacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcguacaccggccagcacgaccuggucaucccgcccaacggguacuuccgguucgacagcugggugaaccaguucuacacccuggcccccaugggcaacgggacgggccgccggcgcuga

SEQ ID NO: 12284 - RNA, 1617 nt, Artificial Sequence
  derived and/or modified sequence opt1 from VP1__Norovirus_and/or_Norovirus-like__KF060028
augaagauggccagcuccgacgcccaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccgggccgacggcuccacgcgcgggcacaaggccaccguguacaccggcagcgccgacuucuccccgaagcugggccggguccaguucgccaccgacacggacaacgacuucguggccaaccagaacaccaaguucacccccgugggggucauccaggacggcagcaccacgccccgcaacgagccccagcagugggugcugccguccuacagcgggcggaacacccacaacgugcaccucgcccccgcggucgcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacguggcccuccugcgguucgucaacccggacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgguga

SEQ ID NO: 12285 - RNA, 1617 nt, Artificial Sequence
  derived and/or modified sequence opt1 from VP1__Norovirus_and/or_Norovirus-like__KF060022
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcgccuuccggggcgacgugacgcacaucagcggcucccgcaacuacaccaugaaccuggccagccagaacuggaacagcuacgacccgaccgaggagauccccgcgccccuggggacccccgacuucgucggcaagauccaggggaugcucacgcagaccacccggaccgacggcuccacgcgcgggcacaaggccaccguguacaccggcagcgccgacuucuccccgaagcugggccgggugcaguucgccaccgacacggacaacgacuucgucaccaaccagaacaccaaguucacccccgugggggugauccaggacggcagcacgacgccccgcaacgagccccagcaguggguccugccguccuacagcgggcggaacacccacaacgugcaccucgcccccgccguggcgcccaccuuccccggcgagcagcugcuguucuuccgcuccaccaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12286 - RNA, 1617 nt, Artificial Sequence
  derived and/or modified sequence opt1 from VP1__Norovirus_and/or_Norovirus-like__KC517376
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcucuccaccggcccgagcuccgccuucgucgugcagccccagaacgggcgcugcaccacggacggcgugcugcuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12287 - RNA, 1617 nt, Artificial Sequence
  derived and/or modified sequence opt1 from VP1__Norovirus_and/or_Norovirus-like__KC517374
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagacgcccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcgggaccacccaccgcaacgagccccagcagugggugcugcccuccuacagcggccggaacacccacaacguccaccucgccccggcgguggcccccacguuccccggggagcagcugcuguucuuccgcuccaccaugcccggcugcagcggcuacccgaacauggaccucgacugccugcugccccaggagugggugcaguacuucuaccaggaggccgcccccgcgcacuccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggagcggcaccggccgccgccgguga

SEQ ID NO: 12288 - RNA, 1617 nt, Artificial Sequence
  derived and/or modified sequence opt1 from VP1__Norovirus_and/or_Norovirus-like__KC409308
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcaguggaugcuccccuccuacagcggccgggacgugcacaacguccaccuggccccggccguggcgcccacguuccccggcgagcagcuccucuucuuccgcuccaccaugcccgggugcagcggcuacccgaacauggaccuggacugccugcucccccaggagugggugcagcacuucuaccaggaggccgcccccgcccaguccgacgucgcgcugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcuga

SEQ ID NO: 12289 - RNA, 1617 nt, Artificial Sequence
  derived and/or modified sequence opt1 from VP1__Norovirus_and/or_Norovirus-like__KC175393
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcggggccuucgugguccagccgcagaacggccggugcaccaccgacggggugcugcugggcaccacgcagcucucccccgucagcaucugcaccuuccgcggcgacgugacccacaucgccgggucccggaacuacaccaugaaccuggccagccugaacuggaacaacuacgaccccacggaggagaucccggcgccccucggcacccccgacuucguggggaagauccagggcguccugacccagaccacgaagggggacggcuccacccgcggccacaaggccaccguguacaccgggagcgcccccuucacgccgaagcugggcagcgugcaguucuccaccgacaccgagaacgacuucgagacccaccagaacacgaaguucacccccgucggggugauccaggacggcgggaccacccaccggaacgagccccagcagugggugcuccccagcuacuccggccgcgacguccacaacgugcaccuggccccggccguggcgcccacguuccccggcgagcagcuccucuucuuccggagcaccaugcccgggugcuccggcuacccgaacauggaccuggacugccugcucccccaggaguggguccagcacuucuaccaggaggccgcccccgcccagagcgacguggcgcugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacgcucgcccccaugggcaacgggaccggccggcgccgcuga

SEQ ID NO: 12290 - RNA, 1617 nt, Artificial Sequence
  derived and/or modified sequence opt1 from VP1__Norovirus_and/or_Norovirus-like__JX459623
augaagauggccagcaacgaccccaaccccuccgacggcagcgccgcgaaccuggugcccgaggucaacaacgaggugauggcccucgagcccguggucggggccgccaucgccgcgcccguggccggccagcagaacgugaucgacccguggauccgcaacaacuucguccaggcccccgggggcgaguucaccgugagcccccggaacgcccccggggagauccugugguccgcgccgcugggccccgaccucaaccccuaccugucccaccuggcccgcauguacaacggcuacgccgggggcuucgaggugcaggucauccucgccgggaacgccuucaccgcgggcaagaucaucuucgccgccgugcccccgaacuuccccacggaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggggccuucgugguccagccccagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgacccgacggaggagauccccgcgccccucggcacccccgacuucguggggaagauccagggcguccugacccagaccacgaagggggacggcuccacccggggccacaaggccaccguguacaccgggagcgccccguucacgcccaagcugggcuccgugcaguucagcaccgacaccgagaacgacuucgagacccaccagaacacgaaguucacccccgucggggugauccaggacggcgggaccacccaccgcaacgagccccagcagugggugcucccgagcuacuccggccggaacguccacaacgugcaccuggcccccgccguggcccccacguuccccggcgagcagcuccucuucuuccgcagcaccaugccggggugcuccggcuaccccaacauggaccuggacugccugcucccccaggaguggguccagcacuucuaccaggaggcggcccccgcccagagcgacguggcccugaugcgguucgugaacccggacaccgggcgcguccuguucgagugcaagcuccacaaguccggcuacgugaccguggcgcacaccgggcagcacgaccuggucaucccgcccaacggcuacuuccgguucgacagcugggugaaccaguucuacacgcuggcccccaugggcaacgggaccggccgccggcgcuga

SEQ ID NO: 12291 - RNA, 1617 nt, Artificial Sequence
  derived and/or modified sequence opt1 from VP1__Norovirus_and/or_Norovirus-like__JQ798158
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccuggcccaccuggcccgcauguacaacggcuacgccgggggcuucgaggugcaggucauccucgccgggaacgcguucacggccggcaagaucaucuucgccgccgugccgcccaacuucccgaccgaggggcugucccccagccaggugaccauguucccccacaucgucguggacgugcggcagcuggagcccguccucaucccgcugcccgacgugggcaacaacuucuaccacuacaaccaguccaacgaccccaccaucaagcugaucgccaugcucuacacgccccugcgcgcgaacaacgccggcgaggacguguucaccgucagcugccgggugcugacccgcccgucccccgacuucgacuucaucuuccucgugccgcccaccgucgagagccggacgaagcccuucaccgugcccauccugaccguggaggagaugaccaacucccgcuuccccaucccccuggagaagcuguucacggggccgagcggcgccuucgucgugcagccccagaacgggcggugcaccaccgacggcguccuccugggcaccacgcagcucucccccgugaacaucugcaccuuccgcggggacgugacccacaucgccggcacccacaacuacacgaugaaccuggccagccagaacuggaacaacuacgacccgaccgaggagauccccgcgccccuggggacccccgacuucgucggccggauccaggggaugcucacccagacgacccgcggcgacggcuccacccgggggcacaaggccaccgugagcacgggcgacgugcacuucaccccgaagcugggguccauccaguucaacaccgacaccaacaacgacuucgagacgggccagaacaccaaguucacccccgucgggguggugcaggacggcaacggcgcccaccagaacgagccccagcaguggguccugcccagcuacuccgggcgcaccggccacaacgugcaccucgccccggccguggcgcccacguuccccggggagcagcugcuguucuuccggagcaccaugcccggcugcagcggguacccgaacaugaaccucgacugccugcugccccaggaguggguccagcacuucuaccaggaggccgcccccgcccaguccgacguggcgcuccugcgcuucgugaaccccgacaccggccggguccuguucgagugcaagcuccacaagagcggcuacgugaccguggcccacaccgggcagcacgaccuggucaucccgcccaacggcuacuuccgcuucgacuccugggugaaccaguucuacacgcuggcccccauggggaacggcaccggccggcgccgguga

SEQ ID NO: 12292 - RNA, 1617 nt, Artificial Sequence
  derived and/or modified sequence opt1 from VP1__Norovirus_and/or_Norovirus-like__JQ613566
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccgucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucccgggcagccgcaacuacaccaugaaccuggccucccagaacuggaacagcuacgaccccaccgaggagauccccgcgccccuggggacgccggacuucgugggcaagauccagggggugcucacccagaccacccggacgaacggcagcacccgcgggcacaaggccaccgucuacaccggcuccgccgacuucagccccaagcugggccgggugcaguucgccacggacaccgacaacgacuucgagaccaaccagaacaccaaguucacgcccgugggggucauccaggacggcuccaccacgccccgcaacgagccgcagcagugggugcugcccagcuacuccgggcggaacauccacaacgugcaccucgcccccgccgucgcccccaccuucccgggcgagcagcugcuguucuuccgcagcaccaugcccgggugcuccggcuaccccaacauggaccucgacugccugcugccccaggagugggugcaguacuucuaccaggaggcggccccggcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggacgggccgccgccgguga

SEQ ID NO: 12293 - RNA, 1617 nt, Artificial Sequence
  derived and/or modified sequence opt1 from VP1__Norovirus_and/or_Norovirus-like__AB541287
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucgugcucgccgggaacgccuucaccgccggcaaggugaucuucgccgccgucccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcggggccuucgugguccagccgcagaacggccgcugcacgaccgacggggugcugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccacccccuucacgccgaagcugggcagcgugcaguucagcaccgacaccgagaacgacuucgagaaccaccagaacaccaaguucacgcccgugggggucauccaggacggcgggaccacccaccgcaacgagccccagcagugggugcuccccuccuacagcggccggaacgugcagaacguccaccuggccccggccguggcccccaccuuccccggcgagcagcuccucuucuuccgcuccacgaugcccgggugcagcggcuacccgaacauggaccuggacugccugcucccccaggagugggugcagcacuucuaccaggaggcggcccccgcccaguccgacgucgcccugcugcgguucgugaaccccgacaccgggcgcguccucuucgagugcaagcugcacaagagcggcuacgugaccguggcgcacaccgggcagcacgaccuggugaucccgcccaacggcuacuuccgguucgacuccugggucaaccaguucuacacccucgcccccaugggcaacgggacgggccgccggcgcuga

SEQ ID NO: 12294 - RNA, 1617 nt, Artificial Sequence
  derived and/or modified sequence opt1 from VP1__Norovirus_and/or_Norovirus-like__AB504320
augaagauggccagcaacgacgccaaccccuccgacggcagcgcggccaaccuggugccggaggucaacaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgcgaugcucuacacgccccugcgggccaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcggggccuucguggugcagccgcagaacggccgcugcacgaccgacgggguccugcugggcaccacccagcucucccccgugaacaucugcacguuccggggcgacgucacccacaucgccgggacccgcaacuacaccaugaaccuggcgagccugaacuggaacaacuacgaccccacggaggagaucccggcgccccucggcacccccgacuucguggggaagauccagggcgugcugacccagaccacgaagggggacggcuccacccggggccacaaggccaccgucuacaccgggagcgcccccuucacgccgaagcugggcuccgugcaguucagcaccgacaccgagaacgacuucgagacccaccagaacacgaaguucacccccgugggggucauccaggacggcgggaccacccaccgcaacgagccccagcagugggugcuccccagcuacuccggccggaacgugcacaacguccaccuggccccggccguggcccccacguuccccggcgagcagcuccucuucuuccgcagcaccaugcccgggugcuccggcuacccgaacauggaccuggacugccugcucccccaggagugggugcagcacuucuaccaggaggccgcccccgcgcagagcgacgucgcccugaugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccaugggcaacgggaccggccgccggcgcuga

SEQ ID NO: 12295 - RNA, 1617 nt, Artificial Sequence
  derived and/or modified sequence opt1 from VP1__Norovirus_and/or_Norovirus-like__KU683739
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 12296 - RNA, 1617 nt, Artificial Sequence
  derived and/or modified sequence opt1 from VP1__Norovirus_and/or_Norovirus-like__KX354146
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccggcugcccaucccccucgagaagcuguucaccggcccguccagcgccuucgucgugcagccccagaacgggcgcugcaccacggacggcguccugcucgggaccacccagcugucccccgugaacaucugcaccuuccggggcgacgugacgcacaucaccggcagccgcaacuacaccaugaaccuggccucccagaacuggaacaacuacgacccgaccgaggagauccccgcgccccucgggacgcccgacuucgucggcaagauccaggggaugcugacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcuccccagcuacuccgggcggaacacccacaacguccaccuggccccggcgguggcccccaccuuccccggcgagcagcuccucuucuuccgcagcacgaugcccgggugcuccggcuacccgaacauggaccuggacugccugcucccccaggagugggugcaguacuucuaccaggaggccgcccccgcgcagagcgacgucgcccugcugcgguucgugaaccccgacaccggccgcgugcuguucgagugcaagcugcacaaguccggguacgucaccguggcccacaccggccagcacgaccuggugaucccgcccaacggguacuuccgguucgacagcugggucaaccaguucuacacccucgcccccaugggcaacgggacgggccgccgccgguga

SEQ ID NO: 12297 - RNA, 1617 nt, Artificial Sequence
  derived and/or modified sequence opt1 from VP1__Norovirus_and/or_Norovirus-like__KX354075
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacgcccacaacgugcaccucgcccccgccgucgcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacguggcgcuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 12298 - RNA, 1617 nt, Artificial Sequence
  derived and/or modified sequence opt1 from VP1__Norovirus_and/or_Norovirus-like__KX354072
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaagggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacaccccgccccgggcgaacaacgccggcgacgacguguucacggugagcugccgcguccugacccggcccucccccgacuucgacuucaucuuccuggugccgcccaccguggagagccgcaccaagcccuucacgguccccauccucaccguggaggagaugaccaacucccgguuccccaucccccuggagaagcuguucaccggcccgagcuccgccuucgugguccagccccagaacgggcgcugcacgaccgacggcgugcuccuggggaccacccagcugagccccgucaacaucugcacguuccggggcgacgugacccacaucgccggcucccgcaacuacaccaugaaccucgccagccugaacuggaacaacuacgacccgaccgaggagauccccgcgccccuggggacgcccgacuucgugggcaagauccaggggguccucacccagaccaccaagggcgacggguccacgcggggccacaaggccaccguguacaccggcagcgccgacuucaccccgaagcuggggagcgugcaguucgccacggacaccgagaacgacuucgagacccaccagaacacccgcuucacgcccgucggcgugauccaggacggguccaccacccaccggaacgagccccagcagugggugcugcccagcuacuccggccgcaacguccacaacgugcaccucgccccggcgguggcccccaacuuccccggggagcagcugcuguucuuccggagcaccaugcccggcugcuccggcuacccgaacauggaccucgacugccugcugccccaggaguggguccagcacuucuaccaggaggccgcccccgcgcagagcgacguggcccuccugcgcuucgugaaccccgacacggggcggguccuguucgagugcaagcuccacaaguccggcuacgugaccguggcccacaccgggcagcacgaccuggucaucccgcccaacggcuacuuccgcuucgacagcugggugaaccaguucuacacccuggcccccauggggaacggcaccggccggcgccgcuga

SEQ ID NO: 12299 - RNA, 1617 nt, Artificial Sequence
  derived and/or modified sequence opt1 from VP1__Norovirus_and/or_Norovirus-like__KX354060
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgccacggacaccaacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcagcacuucuaccaggaggcggcccccgcccagagcgacgucgcccuccugcgguucgugaacccggacaccggccgcgugcuguucgagugcaagcuccacaaguccggguacgucaccguggcgcacaccggccagcacgaccuggugaucccgcccaacggguacuuccgguucgacagcugggucaaccaguucuacacccuggcccccaugggcaacgggacgggccgccggcgcuga

SEQ ID NO: 12300 - RNA, 1617 nt, Artificial Sequence
  derived and/or modified sequence opt1 from VP1__Norovirus_and/or_Norovirus-like__KX353959
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccgccacgccccgcaacgagccgcagcaguggguccugcccagcuacuccgggcggaacauccacaacgugcaccucgcccccgccguggcgcccaccuucccgggcgagcagcugcuguucuuccgcagcaccaugcccgggugcuccggcuaccccaacauggaccucgacugccugcugccccaggaguggguccaguacuucuaccaggaggccgccccggcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgguga

SEQ ID NO: 12301 - RNA, 1617 nt, Artificial Sequence
  derived and/or modified sequence opt1 from VP1__Norovirus_and/or_Norovirus-like__KX353954
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggagcauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12302 - RNA, 1617 nt, Artificial Sequence
  derived and/or modified sequence opt1 from VP1__Norovirus_and/or_Norovirus-like__AB972529
augaagauggccagcuccgacgccaaccccagcgacggcuccgcggccaaccuggugcccgaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccgccggcgcuga

SEQ ID NO: 12303 - RNA, 1617 nt, Artificial Sequence
  derived and/or modified sequence opt1 from VP1__Norovirus_and/or_Norovirus-like__AB972504
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagacgcccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccacgacuucgaggccaaccagaacaccaaguucacgcccgucggggugauccaggacggcagcaccacccaccgcaacgagccccagcagugggugcugcccuccuacagcgggcggaacaccccgaacguccaccucgcccccgcgguggcccccacguuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgguga

SEQ ID NO: 12304 - RNA, 1617 nt, Artificial Sequence
  derived and/or modified sequence opt1 from VP1__Norovirus_and/or_Norovirus-like__AB972503
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagacgcccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccgcgacuucgaggccaaccagaacaccaaguucacgcccgucggggugauccaggacggcagcaccacccaccggaacgagccccagcagugggugcugcccuccuacagcgggcgcaacaccccgaacguccaccucgcccccgcgguggcccccacguuccccggcgagcagcugcuguucuuccgguccaccaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacgcuggcccccaugggcaacgggaccggccgccggcgcuga

SEQ ID NO: 12305 - RNA, 1617 nt, Artificial Sequence
  derived and/or modified sequence opt1 from VP1__Norovirus_and/or_Norovirus-like__KP244322
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgcgcgacgacguguucaccgugagcugccggguccugacccgcccgucccccgacuucgacuucaucuuccucgugccgcccaccguggagagccggacgaagcccuucuccguccccgugcugaccguggaggagaugaccaacagccgcuuccccaucccccuggagaagcuguucaccggcccguccagcgccuucgucgugcagccccagaacggccggugcacgaccgacgggguccuccugggcaccacccagcucucccccgugaacaucugcacguuccgcggggacgugacccacaucagcggcucccggaacuacaccaugaaccuggccagccagaacuggaacagcuacgacccgaccgaggagauccccgcgccccugggcacgcccgacuucgucgggaagauccagggcgugcucacccagaccacccgcacggacggguccacccggggccacaaggccaccguguacaccgggagcgccgacuucuccccgaagcugggccgcguccaguucgccacggacaccgacaacgacuucgagaccaaccagaacaccaaguucacgcccgugggcgugauccaggacgggggcaccacccaccggaacgagccccagcaguggguccugcccaacuacagcgggcgcaacacccacaacgugcaccucgccccggccguggcccccacguuccccggcgagcagcugcuguucuuccgguccaccaugcccgggugcagcggcuacccgaacauggaccucgacugccugcugccccaggaguggguccaguacuucuaccaggaggcggcccccgcccaguccgacguggcccuccugcgcuucgugaaccccgacaccggccggguccuguucgagugcaagcuccacaagagcggguacgugaccguggcgcacaccggccagcacgaccuggucaucccgcccaacggguacuuccgcuucgacuccugggugaaccaguucuacacgcuggcccccaugggcaacgggaccggccgccggcgcuga

SEQ ID NO: 12306 - RNA, 1617 nt, Artificial Sequence
  derived and/or modified sequence opt1 from VP1__Norovirus_and/or_Norovirus-like__LC018706
augaagauggccagcuccgacgccaaccccagcgacggcuccgcggccaaccuggugcccgaggucaacaacgaggacauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccaacuucuccccgaagcugggccgggugcaguucgagacggacaccgaccacgacuucgaggugaaccagaacaccaaguucacccccgucggggugauccaggacggcgggacgacccaccgcaacgagccccagcagugggugcugcccagcuacuccggccggaacaccccgaacguccaccucgcccccgccguggcccccaccuuccccggggagcagcugcuguucuuccgcagcacgaugccgggcugcuccggcuaccccaacauggaccucgacugccugcugccccaggagugggugcaguacuucuaccaggaggcggcccccgcccagagcgacgucgcccuccugcgguucgugaacccggacaccgggcgcgugcuguucgagugcaagcuccacaaguccggcuacgucaccguggcgcacaccgggcagcacgaccuggugaucccgcccaacggcuacuuccgguucgacagcugggucaaccaguucuacacccuggcccccauggggaacggcacgggccgccgccgguga

SEQ ID NO: 12307 - RNA, 1617 nt, Artificial Sequence
  derived and/or modified sequence opt1 from VP1__Norovirus_and/or_Norovirus-like__KP096345
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacugggggaacuacgacccgaccgaggagauccccgcgccccugggcacgcccgacuucguggggaagauccagggcguccucacccagaccacccggacggacgggagcacccgcggccacaaggccaccguguacaccggcagcgccgacuucgccccgaagcuggggcgggugcaguucgagacggacaccgaccacgacuucgaggccaaccagaacaccaaguucacccccgucggcgugauccaggacggguccacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12308 - RNA, 1617 nt, Artificial Sequence
  derived and/or modified sequence opt1 from VP1__Norovirus_and/or_Norovirus-like__KM982939
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgccuacaccggccagcacgaccuggugaucccgcccaacggguacuuccgguucgacuccugggugaaccaguucuacacccuggcccccaugggcaacgggacgggccgccgccgguga

SEQ ID NO: 12309 - RNA, 1617 nt, Artificial Sequence
  derived and/or modified sequence opt1 from VP1__Norovirus_and/or_Norovirus-like__KM198588
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggcccuccccuccuacagcggccgggacgugcacaacguccaccuggccccggcgguggcccccacguuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcuga

SEQ ID NO: 12310 - RNA, 1617 nt, Artificial Sequence
  derived and/or modified sequence opt1 from VP1__Norovirus_and/or_Norovirus-like__KM198544
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccaccugaucgucgacgugcggcagcucgagcccgugcugaucccgcugcccgacguccgcaacaacuucuaccacuacaaccaguccaacgaccccaccaucaagcucaucgccaugcuguacacgccccugcgggccaacaacgcgggcgacgacguguucaccgugagcugccgcguccucacccggccgucccccgacuucgacuucaucuuccuggugccgcccaccguggagagccgcacgaagcccuucuccguccccgugcugaccguggaggagaugaccaacagccgguuccccaucccccucgagaagcuguucaccggcccguccagcgccuucgucgugcagccccagaacgggcgcugcacgaccgacggcguccugcucgggaccacccagcugucccccgugaacaucugcacguuccggggcgacgugacccacaucagcggcucccgcaacuacaccaugaaccuggccagccagaacuggaacagcuacgacccgaccgaggagauccccgcgccccucgggacgcccgacuucgucggcaagauccagggggugcugacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggacgggccgccgccgguga

SEQ ID NO: 12311 - RNA, 1617 nt, Artificial Sequence
  derived and/or modified sequence opt1 from VP1__Norovirus_and/or_Norovirus-like__KM198522
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcggggccuucgugguccagccgcagaacggccggugcaccaccgacggggugcugcugggcaccacgcagcucucccccgucaacaucugcaccuuccgcggcgacgugacccacaucgccgggagccggaacuacaccaugaaccuggccucccugaacuggaacaacuacgaccccacggaggagaucccggcgccccucggcacccccgacuucguggggaagauccagggcguccugacccagaccacgaagggggacggcagcacccgcggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccggaacgagccccagcagugggugcuccccuccuacagcggccgcgacguccacaacgugcaccuggccccggccguggcgcccacguuccccggcgagcagcuccucuucuuccgguccaccaugcccgggugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcacaagagcggcuacgugaccguggcccacaccgggcagcacgaccuggucaucccgcccaacggcuacuuccgcuucgacuccugggugaaccaguucuacacgcucgcccccaugggcaacgggaccggccggcgccgcuga

SEQ ID NO: 12312 - RNA, 1617 nt, Artificial Sequence
  derived and/or modified sequence opt1 from VP1__Norovirus_and/or_Norovirus-like__KM198508
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacgcggcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcuga

SEQ ID NO: 12313 - RNA, 1617 nt, Artificial Sequence
  derived and/or modified sequence opt1 from VP1__Norovirus_and/or_Norovirus-like__KJ716367
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggcaucgugcaguucgagacggacaccgaccacgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgcuga

SEQ ID NO: 12314 - RNA, 1617 nt, Artificial Sequence
  derived and/or modified sequence opt1 from VP1__Norovirus_and/or_Norovirus-like__KF177440
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccuccauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12315 - RNA, 1617 nt, Artificial Sequence
  derived and/or modified sequence opt1 from VP1__Norovirus_and/or_Norovirus-like__KF060117
augaagauggccagcuccgacgcccaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacgggaccggccgccgccgguga

SEQ ID NO: 12316 - RNA, 1617 nt, Artificial Sequence
  derived and/or modified sequence opt1 from VP1__Norovirus_and/or_Norovirus-like__KF060104
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccuccuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgguga

SEQ ID NO: 12317 - RNA, 1617 nt, Artificial Sequence
  derived and/or modified sequence opt1 from VP1__Norovirus_and/or_Norovirus-like__KF060095
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccggggccuucgucgugcagccccagaacggccgcugcacgaccgacgggguccuccugggcaccacccagcucagccccgugaacaucugcacguuccggggcgacgugacccacaucuccgggagccgcaacuacaccaugaaccuggccucccagaacuggaacagcuacgacccgaccgaggagauccccgcgccccugggcacgcccgacuucgucgggaagauccagggcgugcucacccagaccacccggacggacgggagcacccgcggccacaaggccaccguguacaccggcuccgccgacuucagcccgaagcuggggcggguccaguucgccacggacaccgacuccgacuucgugaccaaccagaacaccaaguucacgcccgugggcgucauccaggacgggagcaccacgccccgcaacgagccccagcagugggugcugccguccuacagcggccgguccacccacaacgugcaccucgcccccgccgucgcccccaccuuccccggggagcagcugcuguucuuccgcagcaccaugccgggcugcuccggcuaccccaacauggaccucgacugccugcugccccaggagugggugcaguacuucuaccaggaggcggcccccgcccagagcgacguggcccuccugcgguucgucaacccggacaccgggcgcgugcuguucgagugcaagcuccacaaguccggcuacgugaccgucgcgcacaccgggcagcacgaccuggugaucccgcccaacggcuacuuccgguucgacagcugggugaaccaguucuacacgcuggcccccauggggaacggcaccggccgccgccgguga

SEQ ID NO: 12318 - RNA, 1617 nt, Artificial Sequence
  derived and/or modified sequence opt1 from VP1__Norovirus_and/or_Norovirus-like__KF060084
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacggggccggccgccgccgguga

SEQ ID NO: 12319 - RNA, 1617 nt, Artificial Sequence
  derived and/or modified sequence opt1 from VP1__Norovirus_and/or_Norovirus-like__KF060082
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccaguacgaccuggucaucccgcccaacggguacuuccgguucgacagcugggugaaccaguucuacacccuggcccccaugggcaacgggacgggccgccgccgguga

SEQ ID NO: 12320 - RNA, 1617 nt, Artificial Sequence
  derived and/or modified sequence opt1 from VP1__Norovirus_and/or_Norovirus-like__KF060079
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggagcuccuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgguga

SEQ ID NO: 12321 - RNA, 1617 nt, Artificial Sequence
  derived and/or modified sequence opt1 from VP1__Norovirus_and/or_Norovirus-like__KF060058
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccuccacgauccuguggagcgcgccccuggggccggaccucaaccccuaccugucccaccuggcccgcauguacaacggcuacgccggcggguucgaggugcaggucauccucgccggcaacgccuucaccgcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggggacgacguguucaccguguccugccgcguccugacccggccgagccccgacuucgacuucaucuuccucgugccgcccaccguggagucccgcaccaagcccuucagcguccccgugcugaccguggaggagaugaccaacucccgguuccccaucccccuggagaagcuguucacgggcccgagcuccgccuucgucgugcagccccagaacggccgcugcaccaccgacgggguccuccugggcaccacgcagcucagccccgugaacaucugcaccuuccgcggggacgugacccacaucuccggcagccggaacuacaccaugaaccuggccagccagaacuggaacuccuacgacccgacggaggagauccccgcgccccugggcacccccgacuucgucgggaagauccagggcgugcucacccagaccacgcggaccgacgggagcacccgcggccacaaggccaccguguacacgggguccgccgacuucagcccgaagcugggccggguccaguucgccaccgacaccgacaacgacuucgugaccaaccagaacacgaaguucacccccgugggcgucauccaggacggguccaccacgccccgcaacgagccccagcagugggugcugccgagcuacuccggccggaacauccacaacgugcaccucgcccccgccgucgcccccaccuuccccggggagcagcugcuguucuuccgcagcaccaugccgggcugcuccggguaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggcuacgugaccgucgcgcacaccgggcagcacgaccuggugaucccgcccaacggcuacuuccgguucgacagcugggugaaccaguucuacacgcuggcccccauggggaacggcaccgggcgccgccgguga

SEQ ID NO: 12322 - RNA, 1617 nt, Artificial Sequence
  derived and/or modified sequence opt1 from VP1__Norovirus_and/or_Norovirus-like__KF060039
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccagcgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgguga

SEQ ID NO: 12323 - RNA, 1617 nt, Artificial Sequence
  derived and/or modified sequence opt1 from VP1__Norovirus_and/or_Norovirus-like__KF060030
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggaacgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgccaccgucgcccacaccgggcagcacgaccuggugaucccgcccaacggcuacuuccgguucgacagcugggugaaccaguucuacacccuggcccccauggggaacggcacgggccgccgccgguga

SEQ ID NO: 12324 - RNA, 1617 nt, Artificial Sequence
  derived and/or modified sequence opt1 from VP1__Norovirus_and/or_Norovirus-like__JX439829
augaagaugggcagcaacgacgccaaccccuccgacgggagcaccgccaaccuggugccggaggucaacaacgaggugauggcgcucgagcccguggucggcgccgccaucgccgcccccguggcggggcagcagaacgugaucgaccccuggauccgcaacaacuucguccaggccccgggcggggaguucaccgugagcccccggaacgcccccggcgagauccugugguccgcgccccugggcccggaccucaaccccuaccugucccaccuggcccgcauguacaacggguacgccggcggguucgaggugcaggucauccucgccggcaacgccuucacggccgggaagaucaucuucgcggccgugccgcccaacuuccccaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccgggccgagcuccgcguucgucgugcagccccagaacggccgcugcacgaccgacgggguccuccugggcaccacccagcucagccccgugaacaucugcacguuccggggcgacgugacccacaucccggggucccgcaacuacaccaugaaccuggccagccagaacuggaacuccuacgaccccaccgaggagauccccgcgccccugggcacgccggacuucgucgggaagauccagggcgugcucacccagaccacccggacgaacgggagcacccgcggccacaaggccaccguguacaccggcagcgccgacuucucccccaagcuggggcggguccaguucgccacggacaccgacaacgacuucgagaccaaccagaacaccaaguucacgcccgugggcgugauccaggacgggagcaccacgccccgcaacgagccgcagcaguggguccugcccuccuacagcggccggaacauccacaacgugcaccucgcccccgccguggcccccaccuucccgggggagcagcugcuguucuuccgcuccaccaugcccggcugcagcggcuaccccaacauggaccucgacugccugcugccccaggaguggguccaguacuucuaccaggaggccgcgccggcccaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacgggccgccgccgguga

SEQ ID NO: 12325 - RNA, 1617 nt, Artificial Sequence
  derived and/or modified sequence opt1 from VP1__Norovirus_and/or_Norovirus-like__KC409282
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaccccggcgccccucggcacccccgacuucguggggaagauccagggcguccugacccagacgaccaagggggacggcagcacccggggccacaaggccaccguguacacgggguccgcccccuucaccccgaagcugggcagcgugcaguucagcaccgacaccgagaacgacuucgagacgcaccagaacaccaaguucacccccgucggggugauccaggacggcgggaccacgcaccgcaacgagccccagcagugggugcuccccuccuacagcggccgggacguccacaacgugcaccuggccccggccguggcgcccaccuuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacacggggcagcacgaccuggucaucccgcccaacggcuacuuccgguucgacuccugggugaaccaguucuacacccucgcccccaugggcaacgggaccggccgccggcgcuga

SEQ ID NO: 12326 - RNA, 1617 nt, Artificial Sequence
  derived and/or modified sequence opt1 from VP1__Norovirus_and/or_Norovirus-like__KC409259
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagccgggcuacgugaccguggcccacaccgggcagcacgaccuggucaucccgcccaacggcuacuuccgguucgacagcugggugaaccaguucuacacgcucgcccccaugggcaacgggaccggccgccggcgcuga

SEQ ID NO: 12327 - RNA, 1617 nt, Artificial Sequence
  derived and/or modified sequence opt1 from VP1__Norovirus_and/or_Norovirus-like__JX459659
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgguga

SEQ ID NO: 12328 - RNA, 1617 nt, Artificial Sequence
  derived and/or modified sequence opt1 from VP1__Norovirus_and/or_Norovirus-like__JX459658
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucaucguccagccccagaacgggcgcugcacgaccgacggcgugcuccuggggaccacccagcucucccccgucaacaucugcacguuccggggcgacgugacccacaucagcggcucccgcaacuacaccaugaaccuggccagccagaacuggaacagcuacgacccgaccgaggagauccccgcgccccuggggacgcccgacuucgugggcaagauccaggggguccucacccagaccacccggacggacggcuccacccgcgggcacaaggccaccguguacaccggcagcgccgacuucuccccgaagcugggccgggugcaguucgccacggacaccgacaacgacuucgucaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgguga

SEQ ID NO: 12329 - RNA, 1617 nt, Artificial Sequence
  derived and/or modified sequence opt1 from VP1__Norovirus_and/or_Norovirus-like__JX459595
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugauccccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcgcguucgugguccagccccagaacgggcgcugcaccaccgacggcgugcuccuggggaccacgcagcucucccccgucaacaucugcaccuuccggggcgacgugacccacaucgccggcacccagagcuacacgaugaaccuggccucccagaacuggaacaacuacgacccgaccgaggagauccccgcgccccuggggacccccgacuucgugggcaagauccaggggguccucacccagacgacccgcggcgacgggagcacccggggccacaaggccaccgugagcacgggcuccgugcacuucaccccgaagcuggggagcguccaguucuccaccgacaccagcaacgacuucgagacgggccagaacacccgcuucacccccgugggggugguccaggacggcuccaccacgcaccagaacgagccccagcagugggugcugcccaacuacagcgggcgggacucccacaacgugcaccucgccccggccgucgcccccaccuuccccggcgagcagcugcuguucuuccgcagcaccaugcccggcugcuccggguacccgaacaugaaccucgacugccugcugccccaggagugggugcagcacuucuaccaggagagcgcccccgcccaguccgacguggcgcuccugcgguucgucaaccccgacaccggccgcgugcuguucgagugcaagcuccacaagagcggguacgugaccgucgcccacacgggccagcacgaccuggugaucccgcccaacggguacuuccgguucgacuccugggugaaccaguucuacacccuggcccccaugggcaacggcgccgggcgccggcgcuga

SEQ ID NO: 12330 - RNA, 1617 nt, Artificial Sequence
  derived and/or modified sequence opt1 from VP1__Norovirus_and/or_Norovirus-like__JQ613560
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccgggccaacggcagcacgcgcgggcacaaggccaccguguacaccggcuccgccgacuucagccccaagcugggccggguccaguucgccaccgacacggacaacgacuucgagaccaaccagaacaccaaguucacccccgugggggugauccaggacggcuccacgacgccccgcaacgagccgcagcaguggguccugcccagcuacuccgggcggaacauccacaacgugcaccucgcccccgccguggcgcccaccuucccgggcgagcagcugcuguucuuccgcagcaccaugcccgggugcuccggcuaccccaacauggaccucgacugccugcugccccaggaguggguccaguacuucuaccaggaggccgccccggcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgguga

SEQ ID NO: 12331 - RNA, 1617 nt, Artificial Sequence
  derived and/or modified sequence opt1 from VP1__Norovirus_and/or_Norovirus-like__JQ613545
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacaacuacgaccccaccgaggagauccccgcgccccuggggacgccggacuucgucggcaagauccagggggugcucacccagaccacccggacgaacggcagcacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12332 - RNA, 1617 nt, Artificial Sequence
  derived and/or modified sequence opt1 from VP1__Norovirus_and/or_Norovirus-like__AB541288
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccccugguccgccccgcugggccccgaccugaaccccuaccucucccaccuggcccgcauguacaacggcuacgccgggggcuucgaggugcaggucgugcuggccgggaacgcguucaccgccggcaaggugaucuucgccgccgugcccccgaacuuccccacggaggggcucagccccucccaggucaccauguucccccacaucaucguggacguccggcagcuggagccggugcugaucccccuccccgacgugcgcaacaacuucuaccacuacaaccagagcaacgacuccaccaucaagcugaucgccaugcuguacacgccccuccgggcgaacaacgccggcgaggacgucuucaccgugagcugccgcgugcugacccggccgucccccgacuucgacuucaucuuccuggucccgcccaccguggagagccgcaccaagccguucacggugcccauccucaccgucgaggagaugaccaacucccgguuccccaucccccuggagaagcuguucaccggcccgagcggggccuucgugguccagccccagaacggccgcugcacgaccgacggggugcuccugggcaccacccagcugucccccgugaacaucugcacguuccggggcgacgucacccacaucgccgggagccgcaacuacaccaugaaccucgccucccugaacuggaacaacuacgacccgaccgaggagauccccgcgccccugggcacgcccgacuucguggggaagauccagggcgugcucacccagaccaccaagggggacggcagcacgcggggccacaaggccaccgucuacaccggguccaccccguucacgcccaagcugggcagcgugcaguucagcaccgacaccgagaacgacuucgagaaccaccagaacaccaaguucacgcccgugggggucauccaggacggcgggaccacccaccgcaacgagccccagcagugggugcugccguccuacagcggccggaacgugcagaacguccaccucgcccccgccguggcccccaccuuccccggcgagcagcugcuguucuuccgcuccacgaugccggggugcagcggcuaccccaacauggaccucgacugccugcugccccaggagugggugcagcacuucuaccaggaggcggcccccgcccaguccgacgucgcccuccugcgguucgugaacccggacaccgggcgcgugcuguucgagugcaagcuccacaagagcggcuacgucaccguggcgcacaccgggcagcacgaccuggugaucccgcccaacggcuacuuccgguucgacuccugggucaaccaguucuacacccuggcccccaugggcaacgggacgggccgccggcgcuga

SEQ ID NO: 12333 - RNA, 1617 nt, Artificial Sequence
  derived and/or modified sequence opt1 from VP1__Norovirus_and/or_Norovirus-like__AB541247
augaagauggccagcaacgacgccaaccgcuccgacggcagcgcggccaaccuggugcccgaggucaacaacgaggugauggcccucgagccgguggucggggccgccaucgcggcccccguggccggccagcagaacgugaucgaccccuggauccggaacaacuucguccaggcccccgggggcgaguucaccguguccccgcgcaacgcgcccggggagauccuguggagcgcgccccugggccccgaccucaacccguaccugucccaccuggcccggauguacaacggcuacgccgggggcuucgaggugcaggucauccucgccgggaacgccuucaccgccggcaagaucaucuucgccgccgugccgcccaacuuccccacggaggggcugagccccucccaggugaccauguucccccacaucaucgucgacgugcgccagcuggagcccgugcucaucccccugccggacguccggaacaacuucuaccacuacaaccagagcaacgacuccaccaucaagcugaucgccaugcucuacacgccccugcgcgcgaacaacgccggcgaggacguguucaccgugagcugccggguccugacccgccccucccccgacuucgacuucaucuuccucgugccgcccaccguggagagccggaccaagcccuucacgguccccauccugaccguggaggagaugaccaacucccgcuucccgaucccccuggagaagcuguucaccggccccagcuccgccuucgugguccagccccagaacgggcggugcacgaccgacggcgugcugcuggggaccacccagcucagcccggucaacaucugcacguuccgcggcgacgugacccacaucgccggcucccggaacuacaccaugaaccuggccagccugaacuggaacaacuacgaccccaccgaggagauccccgcgccgcucgggacgcccgacuucgugggcaagauccaggggguccugacccagaccaccaagggcgacggguccacgcgcggccacaaggccaccguguacaccggcagcgcccccuucacccccaagcuggggagcgugcaguucuccacggacaccgagaacgacuucgagacccaccagaacaccaaguucacgccggucggcgugauccaggacgggagcaccacccaccgguccgagccccagcagugggugcuccccagcuacuccggccgcaacguccccaacgugcaccuggccccggccguggcgcccaccuuccccggggagcagcuccucuucuuccggagcacgaugcccggcugcuccggcuacccgaacauggaccuggacugccugcucccccaggaguggguccagcacuucuaccaggaggccgcccccgcccagagcgacguggcgcugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccauggggaacggcacgggccggcgccgcuga

SEQ ID NO: 12334 - RNA, 1617 nt, Artificial Sequence
  derived and/or modified sequence opt1 from VP1__Norovirus_and/or_Norovirus-like__EU839585
augaagauggccagcaacgacgccaaccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcuccuggggaccacgcagcucagccccgucaacaucugcaccuuccggggcgacgugacccacauccccggcacccgcacguaccggaugaaccuggccucccagaacuggaacaacuacgacccgaccgaggagauccccgcgccccuggggacccccgacuucgugggcaagauccaggggaugcucccgcagaccacgaagggcgacgggagcacccgcggccacaaggccaccgucuccaccggcagcguggacuucacgcccaagcuggggagcgugcaguucgccaccgacaccgacaacgacuucgagaccggccagaacacgcgguucacccccgucggggugauccaggacggcuccagcacccaccgcaacgagccccagcagugggugcugccggacuacuccgggcggaccgucuacaacgugcaccucgcccccgccguggcccccacguuccccggcgagcagcugcuguucuuccgcagcaccaugccgggcugcuccggguaccccaacauggaccucgacugccugcugccccaggaguggguccagcacuucuaccaggaggccgcgcccagccaguccgacguggcccuccugcgguucgugaacccggacaccggccgcguccuguucgagugcaagcuccacaaggccggguacgugaccguggcccacaccggccagcacgaccuggucaucccgcccaacggguacuuccgguucgacagcugggugaaccaguucuacacgcuggcgcccaugggcaacggcgccgggcgccgccgguga

SEQ ID NO: 12335 - RNA, 1617 nt, Artificial Sequence
  derived and/or modified sequence opt1 from VP1__Norovirus_and/or_Norovirus-like__AY588021
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacacccgguucacccccgugggcgucgugcaggacgggaacggcacccaccagaacgagccccagcagugggugcugcccuccuacagcggccgcacggggcacaacguccaccucgccccggccguggcccccaccuuccccggcgagcagcugcuguucuuccggagcaccacccccgggugcuccggcuacccgaacaugaaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucacgguggcccacaccggccagcacgaccuggugaucccgcccaacggguacuuccgcuucgacagcugggucaaccaguucuacacccuggcgcccaugggcaacgggaccggccggcgccgcuga

SEQ ID NO: 12336 - RNA, 1617 nt, Artificial Sequence
  derived and/or modified sequence opt1 from VP1__Norovirus_and/or_Norovirus-like__KX514188
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccaucaaccuggacaagcuguucaccgggcccuccagcgccaacgugguccagccgcagaacggccgcugcacgaucgacggggagcugcugggcaccacccagcucucccccgugaacaucugcaccuuccggggcgacgucacgcacccccgcgacagccagaucuacaccaugaaccuggccuccccgaacuggaacaacuacgaccccaccgaggagauccccgcgccccuggggaccccggacuucgugggcaagauccaggggaugcucacgcagaccaccaagggcgaggggagcacccggggccaccgcgccacgguguacgucggcagcgccaacuacgcccccaagcuggggcgggugcaguucgagaccgacaccaccaacgaccuggacgcccaccagaacacgaaguucacccccgugggcgucgugcagggcggggagucccccaaggggagcgagccgcagcagugggugcuccccuccuacagcggccgcgacacccccaacguccaccuggcccccgccguggcgccgaccuuccccggcgagcagcuccucuucuuccgguccacgauccccgggugcggcgggcaccccaacaugaaccuggacugccugcucccgcaggagugggugcagcacuucuaccaggaggccgcccccgcccagagcgacgucgcgcugcugcgcuucgugaaccccgacaccucccggguccucuucgagugcaagcugcacaagagcggcuacgugaccguggcccacaccgggcagcacgaccuggugaucccgcccaacggcuacuuccgcuucgacuccugggucaaccaguucuacacgcucgcccccaugggcaacgggaccggccggaagcgcuga

SEQ ID NO: 12337 - RNA, 1617 nt, Artificial Sequence
  derived and/or modified sequence opt1 from VP1__Norovirus_and/or_Norovirus-like__KX354101
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagacgcccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccgcgacuucgaggccaaccagaacaccaaguucacgcccgucggggugauccaggacggcgggaccacccaccggaacgagccccagcagugggugcugcccuccuacagcggccgcaacacccacaacguccaccucgccccggcgguggcccccacguuccccggggagcagcugcuguucuuccgguccaccaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacgcuggcccccauggggaacggcaccggccgccggcgcuga

SEQ ID NO: 12338 - RNA, 1617 nt, Artificial Sequence
  derived and/or modified sequence opt1 from VP1__Norovirus_and/or_Norovirus-like__KX354023
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccgggccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcuccaccacgcaccgcaacgagccccagcagugggugcugcccagcuacuccgggcggaacacccacaacgugcaccucgcgccgcccgucgcccccaccuuccccggcgagcagcugcuguucuuccgcagcaccaugccggggugcuccggcuaccccaacauggaccucgacugccugcugccccaggagugggugcaguacuucuaccaggaggccgcccccgcgcagagcgacguggcccuccugcgguucgucaacccggacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgguga

SEQ ID NO: 12339 - RNA, 1617 nt, Artificial Sequence
  derived and/or modified sequence opt1 from VP1__Norovirus_and/or_Norovirus-like__KX353979
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaugaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12340 - RNA, 1617 nt, Artificial Sequence
  derived and/or modified sequence opt1 from VP1__Norovirus_and/or_Norovirus-like__AB972491
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugauccacaucacgggcagccgcaacuacaccaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcccccgcgguggcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgguga

SEQ ID NO: 12341 - RNA, 1617 nt, Artificial Sequence
  derived and/or modified sequence opt1 from VP1__Norovirus_and/or_Norovirus-like__AB972469
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcugcuggggaccacccagcucucccccgucaacaucugcacccugcggggcgacgugacgcacaucaccggcagccgcaacuacaccaugaaccuggccucccagaacuggagcaacuacgacccgaccgaggagauccccgcgccccucgggacgcccgacuucgugggcaagauccaggggguccugacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcuccccuccuacagcgggcgcaacaccccgaacguccaccuggcccccgcgguggcccccaccuuccccggcgagcagcuccucuucuuccgguccacgaugccggggugcagcggcuaccccaacauggaccuggacugccugcucccccaggagugggugcaguacuucuaccaggaggccgcccccgcgcaguccgacgucgcccugcugcgcuucgugaacccggacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacgggacgggccgccggcgcuga

SEQ ID NO: 12342 - RNA, 1617 nt, Artificial Sequence
  derived and/or modified sequence opt1 from VP1__Norovirus_and/or_Norovirus-like__LC101819
augaagauggccagcaacgacgacaaccccuccgacggcagcgccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccgggacacccacaacguccaccucgccccggccguggcgcccaccuuccccggggagcagcugcuguucuuccgcagcacgaugcccggcugcuccggcuacccgaacauggaccucgacugccugcugccccaggagugggugcaguacuucuaccaggaggccgcccccgcccagagcgacgucgcgcuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaacaaguucuacacccuggcccccauggggaacggcacgggccgccgccgguga

SEQ ID NO: 12343 - RNA, 1617 nt, Artificial Sequence
  derived and/or modified sequence opt1 from VP1__Norovirus_and/or_Norovirus-like__KT202795
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccagcuacuccggccgcaacaucccgaacguccaccucgcccccgcgguggcccccaccuuccccggggagcagcugcuguucuuccggagcaccaugccgggcugcuccggcuaccccaacauggaccucgacugccugcugccccaggagugggugcaguacuucuaccaggaggccgcccccgcgcagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcaccggccgccggcgcuga

SEQ ID NO: 12344 - RNA, 1617 nt, Artificial Sequence
  derived and/or modified sequence opt1 from VP1__Norovirus_and/or_Norovirus-like__AB933742
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcuggaucaaccaguucuacacccuggcccccaugggcaacgggacgggccgccgccgguga

SEQ ID NO: 12345 - RNA, 1617 nt, Artificial Sequence
  derived and/or modified sequence opt1 from VP1__Norovirus_and/or_Norovirus-like__AB933722
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcgccaagcccuucaccguccccauccugacgguggaggagaugaccaacagccgguuccccaucccccuggagaagcuguucaccggccccuccagcgccuucgugguccagccgcagaacgggcgcugcaccacggacggcgugcuccuggggaccacccagcucucccccgucaacaucugcaccuuccggggcgacgugacgcacaucgccggcagccgcaacuacaccaugaaccuggcgucccccaacuggaacaacuacgacccgaccgaggagauccccgcgccccuggggacccccgacuucgugggcaagauccaggggaugcucacgcagaccaccaagggcgacgggagcacccggggccacaaggccacggucuacaccggcagcgccccguucacccccaagcugggguccgugcaguucagcaccgacacggagaacgacuucgagacccaccagaacaccaaguucacccccgugggcgucauccaggacggguccacgacccaccgcaacgagccccagcagugggugcugccgagcuacuccggccggaacgugcccaacguccaccucgcccccgccguggcccccaccuucccgggggagcagcugcuguucuuccgcagcaccaugcccggcugcuccggcuaccccaacauggaccucgacugccugcugccccaggagugggugcagcacuucuaccaggaggccgccccggcgcagagcgacgucgcccuccugcgguucgugaaccccgacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccggcgcuga

SEQ ID NO: 12346 - RNA, 1617 nt, Artificial Sequence
  derived and/or modified sequence opt1 from VP1__Norovirus_and/or_Norovirus-like__KJ678138
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaucggcagcgccgacuucgccccgaagcugggccgggugcaguucgagaccgacacggaccacgacuucgaggccaaccagaacaccaaguucacccccgucggggugauccaggacggcuccaccacgcaccgcaacgagccccagcagugggugcugcccagcuacuccgggcggaacaccccgaacguccaccucgcccccgcgguggcccccaccuuccccggcgagcagcugcuguucuuccgcagcaccaugccggggugcuccggcuaccccaacauggaccucgacugccugcugccccaggagugggugcaguacuucuaccaggaggccgcccccgcgcagagcgacgucgcccuccugcgguucgugaacccggacacgggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggaccggccgccgccgguga

SEQ ID NO: 12347 - RNA, 1617 nt, Artificial Sequence
  derived and/or modified sequence opt1 from VP1__Norovirus_and/or_Norovirus-like__KP244317
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgcccggcucuacacgccccugcgcgccaacaacgcgggcgacgacguguucaccguguccugccggguccugacccgcccgagccccgacuucgacuucaucuuccucgugccgcccaccguggagucccggacgaagcccuucagcguccccgugcugaccguggaggagaugaccaacucccgcuuccccaucccccuggagaagcuguucaccggcccgagcuccgccuucgucgugcagccccagaacgggcggugcacgaccgacggcguccuccuggggaccacccagcucagccccgugaacaucugcacguuccgcggcgacgugacccacaucuccggcagccggaacuacaccaugaaccuggccagccagaacuggaacuccuacgacccgaccgaggagauccccgcgccccuggggacgcccgacuucgucggcaagauccagggggugcucacccagaccaccaagacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacacccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguuccacacgcuggcccccaugggcaacgggaccggccgccgccgguga

SEQ ID NO: 12348 - RNA, 1617 nt, Artificial Sequence
  derived and/or modified sequence opt1 from VP1__Norovirus_and/or_Norovirus-like__KP698925
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgagaccaaccagaacaccaaguucacgcccgucggggugauccaggacggcagcaccacccaccgcaacgagccccagcagugggugcugcccuccuacagcgggcggaacaccccgaacguccaccucgcccccgccguggcgcccacguuccccggcgagcagcugcuguucuuccgcuccaccaugccggggugcagcggcuaccccaacauggaccucgacugccugcugccccaggagugggugcaguaccucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacgcucgcccccaugggcaacgggaccggccgccgccgguga

SEQ ID NO: 12349 - RNA, 1617 nt, Artificial Sequence
  derived and/or modified sequence opt1 from VP1__Norovirus_and/or_Norovirus-like__LC005727
augaagauggccagcuccgacgccaacccgcccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccccgcugggccccgaccucaaccccuaccugucccaccuggcccgcauguacaacggcuacgccgggggcuucgaggugcaggucauccucgccgggaacgcguucaccgccggcaaggugaucuucgccgccgugcccccgaacuuccccacggaggggcugagccccucccaggucaccauguucccccacaucgugguggacguccggcagcuggagccggugcucaucccccugcccgacgugcgcaacaacuucuaccacuacaaccagagcaacgaccccaccaucaagcugaucgccaugcucuacaccccgcugcgggcgaacaacgccggcgacgacgucuucacgguguccugccgcgugcugacccggcccagccccgacuucgacuucaucuuccucgugcccccgaccgucgagucccgcaccaagcccuucagcgugcccguccugacgguggaggagaugaccaacucccgguuccccaucccgcuggagaagcuguucaccggccccagcuccgccuucgucgugcagccccagaacgggcgcugcaccacggacggcgugcuccuggggaccacccagcucagcccggucaacaucugcaccuuccggggcgacgugacgcacaucaccggcucccacaacuacaccaugaaccuggccagccagaacuggaacaacuacgaccccaccgaggagauccccgcgccccuggggacgccggacuucgugggcaagauccaggggguccucacccagaccacccgcacggacggcuccacccgggggcacaaggccaccguguacaccggcagcgccgacuucgcccccaagcugggccgcgugcaguucgagacggacaccaaccacgacuucgaggccaaccagaacaccaaguucacccccgucggggugauccaggacggcgggacgacccaccggaacgagccccagcagugggugcugccgagcuacuccggccgcaacacccacaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcuga

SEQ ID NO: 12350 - RNA, 1617 nt, Artificial Sequence
  derived and/or modified sequence opt1 from VP1__Norovirus_and/or_Norovirus-like__LC016603
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcaccuccacguaccgcaugaaccuggccagccagaacuggaacaacuacgaccccaccgaggagaucccggcgccccuggggacccccgacuucgugggcaagauccaggggaugcucacccagacgaccaagggcgacgggagcacccggggccacaaggccaccgucuccacgggcagcguggacuucacccccaagcugggguccgugcaguucgccaccgacaccgacaacgacuucgagacgggccagaacacccgcuucaccccggucggggugauccaggacggcagcggggcccaccggaacgagccccagcagugggugcugcccgacuacuccggcaagaccguccacaacgugcaccucgcccccgccguggccccgacguuccccggcgagcagcugcuguucuuccgcagcaccaugcccgggugcuccggcuaccccaacauggaccucgacugccugcugccgcaggaguggguccagcacuucuaccaggaggcggcccccgcccagagcgacguggcccuccugcgguucgugaaccccgacaccgggcgcguccuguucgagugcaagcuccacaagaccggcuacgugaccguggcgcacacggggcagcacgaccuggucaucccgcccaacggcuacuuccgguucgacuccugggugaaccaguucuacacccuggcccccaugggcaacggggccggccgccggcgcuga

SEQ ID NO: 12351 - RNA, 1617 nt, Artificial Sequence
  derived and/or modified sequence opt1 from VP1__Norovirus_and/or_Norovirus-like__LC016599
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccagcacccgcacguaccggaugaaccuggccucccagaacuggaacaacuacgacccgaccgaggagauccccgcgccccugggcacccccgacuucguggggaagauccagggcaugcucacccagacgaccaagggggacggcagcacccgcgggcacaaggccaccgucagcacgggcuccguggacuucaccccgaagcugggcagcgugcaguucgccaccgacaccgacaacgacuucgagacggggcagaacacccgguucacccccgucggcgugauccaggacggguccagcgcccaccgcaacgagccccagcagugggugcugcccgacuacuccggccggaccguccacaacgugcaccucgccccggccguggcccccacguuccccggggagcagcugcuguucuuccgcagcaccaugcccggcugcuccggcuacccgaacauggaccucgacugccugcugccccaggaguggguccagcacuucuaccaggaggcggcccccgcccagagcgacguggcccuccugcgguucgugaaccccgacaccgggcgcguccuguucgagugcaagcuccacaagaccggcuacgugaccguggcgcacacggggcagcacgaccuggucaucccgcccaacggcuacuuccgguucgacuccugggugaaccaguucuacacccuggcccccauggggaacggcgccggccgccgccgguga

SEQ ID NO: 12352 - RNA, 1617 nt, Artificial Sequence
  derived and/or modified sequence opt1 from VP1__Norovirus_and/or_Norovirus-like__KP293587
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcugaagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacuccuacaccaugaaccuggccagccagaacuggagcaacuacgacccgaccgaggagauccccgcgccccuggggacgcccgacuucgugggcaagauccaggggguccucacccagaccacccgcacggacggcuccacccgggggcacaaggccaccguguacaccggcagcgccgacuucgccccgaagcugggccgcgugcaguucgagacggacaccaaccacgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugcggaacggcacggggcgccgccgguga

SEQ ID NO: 12353 - RNA, 1617 nt, Artificial Sequence
  derived and/or modified sequence opt1 from VP1__Norovirus_and/or_Norovirus-like__KP176402
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaaccugguccaggcccccgggggcgaguucaccgugagcccccggaacgcgcccggggagauccugugguccgcgccccucggcccggagcugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccgcaacuacaccaugaaccuggccucccagaacuggagcaacuacgacccgaccgaggagauccccgcgccccucgggacgcccgacuucgugggcaagauccaggggguccugacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcuccccuccuacagcgggcgcaacaccccgaacguccaccuggcccccgcgguggcccccaccuuccccggcgagcagcuccuguucuuccgguccacgaugccggggugcagcggcuaccccaacauggaccuggacugccugcucccccaggagugggugcaguacuucuaccaggaggccgcccccgcgcaguccgacgucgcccugcugcgcuucgugaacccggacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacgggacgggccgccggcgcuga

SEQ ID NO: 12354 - RNA, 1617 nt, Artificial Sequence
  derived and/or modified sequence opt1 from VP1__Norovirus_and/or_Norovirus-like__KJ196287
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggccacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacaucgccggcagccgcaacuacaccaugaaccuggccucccugaacuggaacaacuacgaccccacggaggagaucccggcgccccucgggacccccgacuucgugggcaagauccaggggguccugacccagaccacgaagggcgacgggagcacccggggccacaaggccaccguguacaccggcagcgcccccuucacgccgaagcugggguccgugcaguucagcaccgacaccgagaacgacuucgagacccaccagaacacgaaguucacccccgucggcgugauccaggacgggggcaccacccaccgcaacgagccccagcagugggugcuccccuccuacagcgggcggaacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcuga

SEQ ID NO: 12355 - RNA, 1617 nt, Artificial Sequence
  derived and/or modified sequence opt1 from VP1__Norovirus_and/or_Norovirus-like__KM198480
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcuguacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcuga

SEQ ID NO: 12356 - RNA, 1617 nt, Artificial Sequence
  derived and/or modified sequence opt1 from VP1__Norovirus_and/or_Norovirus-like__KJ716357
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggccacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12357 - RNA, 1617 nt, Artificial Sequence
  derived and/or modified sequence opt1 from VP1__Norovirus_and/or_Norovirus-like__KJ716354
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaucggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgccccggcgguggcccccaccuuccccggggagcagcugcuguucuuccgcuccaccaugcccggcugcagcggcuacccgaacauggaccucgacugccugcugccccaggagugggugcaguacuucuaccaggaggccgcccccgcgcaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgguga

SEQ ID NO: 12358 - RNA, 1617 nt, Artificial Sequence
  derived and/or modified sequence opt1 from VP1__Norovirus_and/or_Norovirus-like__KJ685403
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucacgaccgacaccgacaacgacuucgugaccaaccagaacacgaaguucacccccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacguggcccuccugcgguucgucaacccggacaccggccgcgugcuguucgagugcaagcuccacaagagcggguacgugaccgucgcccacacgggccagcacgaccuggugaucccgcccaacggguacuuccgguucgacuccugggugaaccaguucuacacccuggcgcccaugggcaacgggaccggccgccgccgguga

SEQ ID NO: 12359 - RNA, 1617 nt, Artificial Sequence
  derived and/or modified sequence opt1 from VP1__Norovirus_and/or_Norovirus-like__KF060108
augaagauggccagcuccgacgccaaccccagcgacggcuccagcgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccgugcugacgguggaggagaugaccaacucccgguuccccaucccccuggagaagcuguucaccggcccgagcuccgccuucgucgugcagccccagaacgggcgcugcaccacggacggcguccuccuggggaccacccagcucagccccgugaacaucugcaccuuccggggcgacgugacgcacaucuccggcagccgcaacuacaccaugaaccuggccagccagaacuggaacuccuacgacccgaccgaggagauccccgcgccccuggggacccccgacuucgucggcaagauccagggggugcucacgcagaccacccggaccgacggcagcacgcgcgggcacaaggccaccguguacaccggcuccgccgacuucagcccgaagcugggccggguccaguucgccaccgacacggacaacgacuucgugaccaaccagaacaccaaguucacccccgugggggucauccaggacggcuccacgacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggacgggccgcaagcgcuga

SEQ ID NO: 12360 - RNA, 1617 nt, Artificial Sequence
  derived and/or modified sequence opt1 from VP1__Norovirus_and/or_Norovirus-like__KF060099
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacggacggcagcacccgcgggcacaaggccaccguguacaccggcuccgccgacuucagccccaagcugggccggguccaguucgccacggacaccgacaacgacuucgugaccaaccagaacaccaaguucacgcccgugggggucauccaggacggcuccaccacgccccgcaacgagccgcagcagugggugcugcccagcuacuccgggcggaacacccacaacgugcaccucgcccccgccgucgcccccaccuucccgggcgagcagcugcuguucuuccgcagcaccaugcccgggugcuccggcuaccccaacauggaccucgacugccugcugccccaggagugggugcaguacuucuaccaggaggcggccccggcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgguga

SEQ ID NO: 12361 - RNA, 1617 nt, Artificial Sequence
  derived and/or modified sequence opt1 from VP1__Norovirus_and/or_Norovirus-like__KF060004
augaagauggccagcuccgacgccaaccccagcgacggcuccguggcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgcgggcaaggugaucuucgccgccgucccgcccaacuucccgacggaggggcugucccccagccaggugaccauguucccccacaucguggucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugacggucgaggagaugaccaacagccgguuccccaucccccuggagaagcuguucaccggcccguccagcgccuucguggugcagccccagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgacccgaccgaggagauccccgcgccccuggggacgcccgacuucgucggcaagauccagggggugcucacccagaccacccggacggacggcagcacccgcgggcacaaggccaccguguacaccggcagcgccgacuucgccccgaagcugggccggguccaguucgagacggacaccgaccacgacuucgaggccaaccagaacaccaaguucacccccgugggggugauccaggacggcgggacgacccaccgcaacgagccccagcaguggguccugcccuccuacagcggccggaacacccacaacgugcaccucgccccggccguggcgcccaccuuccccggggagcagcugcuguucuuccgcuccacgaugcccggcugcagcggcuacccgaacauggaccucgacugccugcugccccaggaguggguccaguacuucuaccaggaggccgcccccgcccaguccgacguggcgcuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacgggccgccgccgguga

SEQ ID NO: 12362 - RNA, 1617 nt, Artificial Sequence
  derived and/or modified sequence opt1 from VP1__Norovirus_and/or_Norovirus-like__KF060006
augaagauggccagcuccgacgccaaccccagcgacggcuccaccgcgagccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacagcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggggacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacggccgcugcacgaccgacgggguccuccugggcaccacccagcucucccccgugaacaucugcacguuccgcggggacgugacccacaucagcggcagccacaacuacaccaugaaccuggccucccagaacuggaacagcuacgacccgaccgaggagauccccgcgccccugggcacgcccgacuucgucgggaagauccagggcgugcucacccagaccacccggaucaacggguccacgcggggccacaaggccaccguguacaccgggagcgccgacuucuccccgaagcugggccgcguccaguucgccaccgacacggacaacgacuucgagaccaaccagaacaccaaguucacccccgugggcgugauccaggacgggagcacgacgccccggaacgagccccagcaguggguccugccguccuacagcggccgcaacacccacaacgugcaccucgcccccgccguggcccccaccuuccccggggagcagcugcuguucuuccgguccaccaugccgggcugcagcggguaccccaacauggaccucgacugccugcugccccaggaguggguccaguacuucuaccaggaggcggcccccgcccaguccgacguggcccuccugcgcuucgugaacccggacaccggccggguccuguucgagugcaagcuccacaagagcggcuacgugaccguggcgcacaccgggcagcacgaccuggucaucccgcccaacggcuacuuccgcuucgacuccugggugaaccaguucuacacccuggcccccauggggaacggcacggggcggcgccgcuga

SEQ ID NO: 12363 - RNA, 1617 nt, Artificial Sequence
  derived and/or modified sequence opt1 from VP1__Norovirus_and/or_Norovirus-like__KC517371
augaagauggccagcaacgacgccaaccccuccgacggcagcgcggccaaccuggugcccgaggucgacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgccccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccugcuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccaggggaugcugacccagaccaccaagggcgacggguccacgcggggccacaaggccaccguguacaccggcagcgcccccuucaccccgaagcuggggagcguccaguucgagacggacaccgagaacgacuucgagacccaccagaacaccaaguucacgcccgugggcgugauccaggacgggggcaccacccaccgcaacgagccccagcaguggguccuccccuccuacagcgggcggaacgugccgaacgugcaccuggcccccgccgucgcccccaccuuccccggcgagcagcuccucuucuuccgcuccacgaugccgggcugcagcggguaccccaacauggaccuggacugccugcucccccaggagugggugcagcacuucuaccaggaggccgcccccgcgcaguccgacguggcccugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgccggcgcuga

SEQ ID NO: 12364 - RNA, 1617 nt, Artificial Sequence
  derived and/or modified sequence opt1 from VP1__Norovirus_and/or_Norovirus-like__JX459657
augaagauggccagcuccgacgcccaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgguga

SEQ ID NO: 12365 - RNA, 1617 nt, Artificial Sequence
  derived and/or modified sequence opt1 from VP1__Norovirus_and/or_Norovirus-like__JX459656
augaagauggccagcuccgacgcccaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12366 - RNA, 1617 nt, Artificial Sequence
  derived and/or modified sequence opt1 from VP1__Norovirus_and/or_Norovirus-like__JX445152
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgaggccgggcagaacacgaaguucacccccgacggcgugguccaggacgggaacggcacccaccagaacgagccccagcagugggugcugcccuccuacagcggccggaccgggcacaacgugcaccucgccccggccaucgcccccacguuccccggcgagcagcugcuguucuuccgcagcaccaugcccgggugcuccggcuacccgaacaugaaccucgacugccugcugccccaggaguggguccagcacuucuaccaggaggcggcccccgcccagagcgacguggcccuccugcgguucgugaaccccgacaccgggcgcguccuguucgagugcaagcuccacaaguccggcuacgugaccguggcgcacaccggccagcacgaccuggucaucccgcccaacggguacuuccgguucgacagcugggugaaccaguucuacacgcuggcccccaugggcaacgggaccggccgccggcgcuga

SEQ ID NO: 12367 - RNA, 1617 nt, Artificial Sequence
  derived and/or modified sequence opt1 from VP1__Norovirus_and/or_Norovirus-like__JQ613553
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccgugcaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12368 - RNA, 1617 nt, Artificial Sequence
  derived and/or modified sequence opt1 from VP1__Norovirus_and/or_Norovirus-like__JQ613521
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcgacuacaccaugaaccuggccagccugaacuggaacaacuacgaccccaccgaggagacgccggcgccccucggcacccccgacuucguggggaagauccagggcaugcugacccagaccacgaagggggacggcuccacccggggccacaaggccaccgucuacaccgggagcgcccccuucacgccgaagcugggcagcgugcgcuucuccaccgacaccgagaacgacuucgagacccaccagaacacgaaguucacccccgugggggucauccaggacggcagcaccacccaccggaacgagccccagcagugggugcuccccuccuacagcgggcgcgacgugcacaacguccaccuggccccggccguggcgcccacguuccccggcgagcagcuccucuucuuccgguccaccaugcccggcugcagcggguacccgaacauggaccuggacugccugcucccccaggagugggugcagcacuucuaccaggaggccgcccccgcccaguccgacgucgcgcugcugcgcuucgugaaccccgacaccggccggguccucuucgagugcaagcugcacaagagcggguacgugaccguggcccacaccggccagcacgaccuggugaucccgcccaacggguacuuccgcuucgacuccugggucaaccaguucuacacgcucgcccccaugggcaacggcaccgggcggcgccgcuga

SEQ ID NO: 12369 - RNA, 1617 nt, Artificial Sequence
  derived and/or modified sequence opt1 from VP1__Norovirus_and/or_Norovirus-like__HQ005298
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggccgcgcccgcccagagcgacguggcccuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccgccgguga

SEQ ID NO: 12370 - RNA, 1617 nt, Artificial Sequence
  derived and/or modified sequence opt1 from VP1__Norovirus_and/or_Norovirus-like__HQ005296
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacacccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggccgcgccggcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacgcuggcgcccaugggcaacgggaccggccgccgccgguga

SEQ ID NO: 12371 - RNA, 1617 nt, Artificial Sequence
  derived and/or modified sequence opt1 from VP1__Norovirus_and/or_Norovirus-like__HM802555
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccgcccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccgcccaguccgacguggcccuccugcgguucgugaaccccgacaccggccgcguccuguucgagugcaagcuccacaagaccggguacgugaccguggcgcacacgggccagcacgaccuggucaucccgcccaacggguacuuccgguucgacagcugggugaaccaguucuacacccuggcccccaugggcaacggcgccgggcgccgccgguga

SEQ ID NO: 12372 - RNA, 1617 nt, Artificial Sequence
  derived and/or modified sequence opt1 from VP1__Norovirus_and/or_Norovirus-like__GQ246801
augaagauggccagcuccgacgcccaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcguacaccggccagcacgaccuggucaucccgcccaacggguacuuccgguucgacagcugggugaaccaguucuacacccuggcccccaugggcaacgggacgggccgccgccgguga

SEQ ID NO: 12373 - RNA, 1617 nt, Artificial Sequence
  derived and/or modified sequence opt1 from VP1__Norovirus_and/or_Norovirus-like__AB504308
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccacggccacaaggccaccgucagcacgggcagcguggacuucaccccgaagcugggguccgugcaguucgccaccgacaccgacaacgacuucgagacgggccagaacacccgcuucacccccgucggggugauccaggacggcagcuccgcccaccggaacgagccccagcagugggugcugcccgacuacagcgggcgcaccguccacaacgugcaccucgccccggccguggcccccacguuccccggcgagcagcugcuguucuuccgguccaccaugcccggcugcagcggguacccgaacauggaccucgacugccugcugccccaggaguggguccagcacuucuaccaggaggcggcccccgcccaguccgacguggcccuccugcgcuucgugaaccccgacaccggccggguccuguucgagugcaagcuccacaagaccggguacgugaccguggcgcacacgggccagcacgaccuggucaucccgcccaacggguacuuccgcuucgacagcugggugaaccaguucuacacccuggcccccaugggcaacggcgccgggcggcgccgcuga

SEQ ID NO: 12374 - RNA, 1617 nt, Artificial Sequence
  derived and/or modified sequence opt1 from VP1__Norovirus_and/or_Norovirus-like__DQ369797
augaagauggcccccaacgacgccagccccuccgacggcagcaccgcgaaccuggugcccgaggucaacaacgaggugauggcccucgagcccguggucggggccgccaucgccgcgcccguggccggccagcagaacgugaucgacccguggauccgcaacaacuucguccaggcccccgggggcgaguucaccgugagcccccggaacgcccccggggagauccugugguccgcgccgcugggccccgaccucaaccccuaccugucccaccuggcccgcauguacaacggcuacgccgggggcuucgaggugcaggucauccucgccgggaacgccuucacggcgggcaagaucaucuucgccgccgugcccccgaacuuccccaccgaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucuccaucugcaccuuccggggcgacgugacccacaucccgggcacccgcaucuaccggaugaaccuggccagccagaacuggaacaacuacgaccccacggaggagauccccgcgccccuggggaccccggacuucgugggcaagauccaggggaugcucacccagaccacgaagggcgacggguccacccgcggccacaaggccaccgucagcaccggcagcguggacuucacgcccaagcugggguccgugcaguucgccaccgacaccgacaacgacuucgagaccggccagaacacgcgguucacccccgucggggugauccaggacggcagcuccgcccaccgcaacgagccccagcagugggugcugccggacuacagcgggcggaccguccacaacgugcaccucgcccccgccguggcccccaccuuccccggcgagcagcugcuguucuuccgcuccacgaugccgggcugcagcggguaccccaacauggaccucgacugccugcugccccaggaguggguccagcacuucuaccaggaggcggcccccucccagagcgacguggcccuccugcgguucgugaacccggacaccggccgcguccuguucgagugcaagcuccacaaggccggguacgugaccguggcgcacaccggccagcacgaccuggucaucccgcccaacggguacuuccgguucgacuccugggugaaccaguucuacacccuggcccccaugggcaacggcgccgggcgccgccgguga

SEQ ID NO: 12375 - RNA, 1617 nt, Artificial Sequence
  derived and/or modified sequence opt1 from VP1__Norovirus_and/or_Norovirus-like__LC177661
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagcaccgacuucgacuucaucuuccucgucccgcccaccguggagucccgcacgaagcccuucagcgugcccguccugaccguggaggagaugaccaacucccgguuccccaucccccuggagaagcuguucaccggccccagcuccgccuucgucgugcagccgcagaacgggcgcugcacgaccgacggcgugcuccuggggaccacccagcucagccccgucaacaucugcacguuccggggcgacgugacccacaucaccggcucccgcaacuacaccaugaaccuggccagccagaacuggaacaacuacgaccccacggaggagaucccggcgccccuggggacccccgacuucgugggcaagauccaggggaugcucacccagaccacgcggaccgacggcagcacccgcgggcacaaggccaccgucuacacgggcuccgccgacuucgcccccaagcugggccgggugcaguucgagaccgacaccgaccacgacuucgaggccaaccagaacaccaaguucacgccggugggggucauccaggacggcagcaccacccaccgcaacgagccccagcagugggugcugcccuccuacagcgggcggaacacccccaacgugcaccucgccccggcggucgcccccacguuccccggcgagcagcugcuguucuuccgcuccaccaugcccgggugcagcggcuacccgaacauggaccucgacugccugcugccccaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacgcuggcccccaugggcaacgggaccggccgccgccgguga

SEQ ID NO: 12376 - RNA, 1617 nt, Artificial Sequence
  derived and/or modified sequence opt1 from VP1__Norovirus_and/or_Norovirus-like__LC175468
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 12377 - RNA, 1617 nt, Artificial Sequence
  derived and/or modified sequence opt1 from VP1__Norovirus_and/or_Norovirus-like__KX354137
augaagauggccagcuccgacgccaaccccagcgacggcuccgcggccaaccuggugccggaggucagcaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccauccugacggucgaggagaugaccaacucccgguuccccaucccccuggagaagcuguucaccggcccgagcuccgccuucguggugcagccccagaacgggcgcugcaccacggacggcguccuccuggggaccacccagcucagccccgugaacaucugcaccuuccggggcgacgucacgcacaucaccggcucccacaacuacaccaugaaccuggccagccagaacuggaacaacuacgacccgaccgaggagauccccgcgccccuggggacgcccgacuucgugggcaagauccagggggugcucacccagaccacccgcagcgacggcuccacgcgggggcacaaggccaccgucuacaccggcagcgccgacuucgccccgaagcugggccgcgugcaguucgagaccgacacggaccgggacuucgagaccaaccagaacaccaaguucacccccgugggggucauccaggacggcacgaccgcccaccgcaacgagccccagcagugggugcugcccuccuacagcgggcggaacauccacaacgugcaccucgccccggcggucgcccccaccuuccccggcgagcagcugcuguccuuccgcagcaccaugcccgggugcuccggcuacccgaacauggaccucgacugccugcugccccaggagugggugcaguacuucuaccaggaggccgcccccgcgcagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgguga

SEQ ID NO: 12378 - RNA, 1617 nt, Artificial Sequence
  derived and/or modified sequence opt1 from VP1__Norovirus_and/or_Norovirus-like__KX354036
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggagcccggacuucgucggcaagauccagggggugcucacgcagaccacccggaccaacggcuccacgcgcgggcacaaggccaccguguacaccggcagcgccgacuucucccccaagcugggccggguccaguucgccaccgacacggacaacgacuucgagaccaaccagaacaccaaguucacccccgugggggugauccaggacggcagcacgacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggaccggccgccgccgguga

SEQ ID NO: 12379 - RNA, 1617 nt, Artificial Sequence
  derived and/or modified sequence opt1 from VP1__Norovirus_and/or_Norovirus-like__KX354011
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucuccguccccauccugaccguggaggagaugaccaacagccgguuccccaucccccuggagaagcuguucaccggccccuccagcgccuucgugguccagccgcagaacgggcgcugcacgaccgacggcgugcuccuggggaccacccagcucucccccgucaacaucugcacguuccggggcgacgugacccacauccccggcagccacaacuacaccaugaaccuggccagccagaacuggaacuccuacgacccgaccgaggagauccccgcgccccuggggacgcccgacuucgugggcaagauccaggggguccucacccagaccaccagcacgaacggcuccacccgcgggcacaaggccaccguguacaccggcagcgccgacuucuccccgaagcugggccgggugcaguucgccacggacaccaacaacgacuucgagaccaaccagaacaccaaguucacgcccgucggggugauccaggacggcagcaccacgccccgcaacgagccccagcagugggugcugccguccuacagcgggcggaacauccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacccuggcccccaugggcaacgggacgggccgccggcgcuga

SEQ ID NO: 12380 - RNA, 1617 nt, Artificial Sequence
  derived and/or modified sequence opt1 from VP1__Norovirus_and/or_Norovirus-like__LC153122
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggucagccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcuccgccgacuucgcccccaagcugggccggguccaguucgagacggacaccgaccacgacuucgaggccaaccagaacaccaaguucaccccggugggggugauccaggacggcagcacgacccaccgcaacgagccccagcaguggguccugcccuccuacagcgggcggaacacccacaacgugcaccucgcccccgccguggcgccgaccuuccccggcgagcagcugcuguucuuccgcuccacgaugcccgggugcagcggcuaccccaacauggaccucgacugccugcugccgcaggaguggguccaguacuucuaccaggaggccgcccccgcccaguccgacguggcgcuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12381 - RNA, 1617 nt, Artificial Sequence
  derived and/or modified sequence opt1 from VP1__Norovirus_and/or_Norovirus-like__KR131777
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggagcagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12382 - RNA, 1617 nt, Artificial Sequence
  derived and/or modified sequence opt1 from VP1__Norovirus_and/or_Norovirus-like__AB933764
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgacgacguguucaccguguccugccgcguccucacccggccgagccccgacuucgacuucaucuuccuggugccgcccaccguggagucccgcacgaagcccuucagcguccccgugcugaccguggaggagaugaccaacucccgguuccccaucccccucgagaagcuguucaccggcccgagcuccgccuucgucgugcagccccagaacgggcgcugcacgaccgacggcguccugcucgggaccacccagcugagccccgugaacaucugcacguuccggggcgacgugacccacaucccgggcucccgcaacuacaccaugaaccuggccagccagaacuggaacuccuacgaccccaccgaggagauccccgcgccccucgggacgccggacuucgucggcaagauccagggggugcugacccagaccacccggacgaacggcagcacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccuccccuccuacagcgggcggaacauccacaacgugcaccuggcccccgccguggcccccaccuucccgggcgagcagcuccuguucuuccgcuccaccaugcccgggugcagcggcuaccccaacauggaccuggacugccugcucccccaggaguggguccaguacuucuaccaggaggcggccccggcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggacgggccgccgccgguga

SEQ ID NO: 12383 - RNA, 1617 nt, Artificial Sequence
  derived and/or modified sequence opt1 from VP1__Norovirus_and/or_Norovirus-like__LC016600
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcaccagcacguaccgcaugaaccuggccucccagaacuggaacaacuacgacccgaccgaggagauccccgcgccccuggggacccccgacuucgugggcaagauccaggggaugcucacccagacgaccaagggcgacgggagcacccggggccacaaggccaccgucagcacgggcuccguggacuucaccccgaagcuggggagcgugcaguucgccaccgacaccgacaacgacuucgagacgggccagaacacccgcuucacccccgucggggugauccaggacggcuccggggcccaccggaacgagccccagcagugggugcugcccaacuacagcggccgcaccguccacaacgugcaccucgccccggccguggcccccacguuccccggcgagcagcugcuguucuuccgguccaccaugcccgggugcagcggcuacccgaacauggaccucgacugccugcugccccaggaguggguccagcacuucuaccaggaggcggcccccgcccaguccgacguggcccuccugcgcuucgugaaccccgacaccgggcggguccuguucgagugcaagcuccacaagaccggcuacgugaccguggcgcacacggggcagcacgaccuggucaucccgcccaacggcuacuuccgcuucgacagcugggugaaccaguucuacacccuggcccccaugggcaacggggccggccggcgccgcuga

SEQ ID NO: 12384 - RNA, 1617 nt, Artificial Sequence
  derived and/or modified sequence opt1 from VP1__Norovirus_and/or_Norovirus-like__KJ433970
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagccgguacgucaccguggcccacaccgggcagcacgaccuggugaucccgcccaacggcuacuuccgcuucgacuccugggucaaccaguucuacacccuggcccccauggggaacggcacggggcgccggcgcuga

SEQ ID NO: 12385 - RNA, 1617 nt, Artificial Sequence
  derived and/or modified sequence opt1 from VP1__Norovirus_and/or_Norovirus-like__KP176395
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccguggacuucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgccguggcgcccaccuuccccggcgagcagcugcuguucuuccgcuccacgaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12386 - RNA, 1617 nt, Artificial Sequence
  derived and/or modified sequence opt1 from VP1__Norovirus_and/or_Norovirus-like__KM982947
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgccguggacgugcggcagcuggagcccguccucaucccgcugcccgacgugcgcaacaacuucuaccacuacaaccaguccaacgaccccaccaucaagcugaucgcgaugcucuacacgccccugcgggccaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccagcuacuccggccggaacaccccgaacgugcaccucgcgcccgccgucgcccccaccuuccccggggagcagcugcuguucuuccgcagcacgaugccgggcugcuccggcuaccccaacauggaccucgacugccugcugccccaggagugggugcaguacuucuaccaggaggccgcgcccgcccagagcgacguggcccuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgguga

SEQ ID NO: 12387 - RNA, 1617 nt, Artificial Sequence
  derived and/or modified sequence opt1 from VP1__Norovirus_and/or_Norovirus-like__KJ685414
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccagcgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12388 - RNA, 1617 nt, Artificial Sequence
  derived and/or modified sequence opt1 from VP1__Norovirus_and/or_Norovirus-like__KF060093
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcaacaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaagcccggguacgugaccgucgcgcacaccggccagcacgaccuggugaucccgcccaacggguacuuccgguucgacuccugggugaaccaguucuacacgcuggcccccaugggcaacgggaccggccgccgccgguga

SEQ ID NO: 12389 - RNA, 1617 nt, Artificial Sequence
  derived and/or modified sequence opt1 from VP1__Norovirus_and/or_Norovirus-like__KC456070
augaagauggccagcuccgacgccaaccccagcgacggcuccgcggccaaccuggugccgaaggucaacaacgaggugauggcccucgagcccguggucggggccgccaucgcggcccccguggccggccagcagaacgugaucgaccccuggaucaagaacaacuucguccaggcccccgggggcgaguucaccgugagccccaagaacgcgcccggggagauccugugguccgcgccccugggcccggaccucaaccccuaccugagccaccuggccaagauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccgccagcuggagcccgugcucaucccgcugcccgacgugcggaacaacuucuaccacuacaaccaguccaacgaccccaccaucaagcugaucgccaugcucuacacgccccugcgcgcgaacaacgccggcgacgacgucuucaccgugagcugccgggugcugacccgcccgucccccgacuucgacuucaucuuccucgucccgcccaccguggagagccggaccaagcccuucuccgugcccguccugacgguggaggagaugaccaacagccgcuuccccaucccccuggagaagcuguucaccggcccguccagcgccuucgucgugcagccccagaacgggcggugcaccacggacggcgugcuccuggggaccacccagcucucccccgucaacaucugcaccuuccgcggcgacgugacgcacaccaucggcagccggaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccgaccacgacuucgaggccaaccagaacaccaaguucacccccgucggggugauccaggacggcuccacgacccaccggaacgagccccagcagugggugcugcccagcuacuccgggcgcaacacccacaacguccaccucgccccggcgguggcccccaccuuccccggcgagcagcugcuguucuuccggagcacgaugcccgggugcuccggcuacccgaacauggaccucgacugccugcugccccaggagugggugcaguacuucuaccaggaggccgcccccgcgcagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccggcgccgguga

SEQ ID NO: 12390 - RNA, 1617 nt, Artificial Sequence
  derived and/or modified sequence opt1 from VP1__Norovirus_and/or_Norovirus-like__KC409299
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccaacgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacuccuacgaccccaccgaggagauccccgcgccccuggggacgccggacuucgucggcaagauccagggggugcucacccagaccacccggacgaacggcagcacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcgggacgugcacaacgugcaccucgcccccgccgucgcccccaccuucccgggcgagcagcugcuguucuuccgcuccaccaugcccgggugcagcggcuaccccaacauggaccucgacugccugcugccccaggagugggugcaguacuucuaccaggaggcggccccggcccaguccgacguggcccuccugcgguucgucaaccccgacaccggccgcgugcuguucgagugcaagcuccacaagagcggguacgugaccgucgcgcacaccggccagcacgaccuggugaucccgcccaacggguacuuccgguucgacuccugggugaaccaguucuacacccuggcccccaugggcaacgggacgggccgccgccgguga

SEQ ID NO: 12391 - RNA, 1617 nt, Artificial Sequence
  derived and/or modified sequence opt1 from VP1__Norovirus_and/or_Norovirus-like__JX984947
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccagcgacuucgacuucaucuuccucgugccgcccaccguggagucccgcaccaagcccuucacgguccccauccugaccguggaggagaugaccaacagccgguucccgaucccccuggagaagcuguucaccggccccuccagcgccuucgugguccagccccagaacgggcgcugcacgaccgacggcgugcugcuggggaccacccagcucuccccggucaacacgugcaccuuccggggcgacgugacccacaucgccggcagccgcaacuacaccaugaaccuggccucccugaacuggaacaacuacgaccccacggaggagauccccgcgccgcucgggacccccgacuucgugggcaagauccaggggguccugacccagaccacgaagggcgacgggagcacccggggccacaaggccaccaucuacaccggcagcgcccccuucacgcccaagcugggguccgugcaguucaacaccgacaccgagaacgacuucgagacccaccagaacacgaaguucaccccggugggcgucauccaggacgggggcaccacccaccgcaacgagccccagcagugggugcuccccagcuacuccgggcggaacauccccaacgugcaccuggccccggccgucgcgcccacguuccccggcgagcagcuccucuucuuccgcagcaccaugcccggcugcuccggguacccgaacauggaccuggacugccugcucccccaggagugggugcagcacuucuaccaggaggccgcccccgcccagagcgacguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacgcucgcccccaugggcaacggcaccgggcgccggcgcuga

SEQ ID NO: 12392 - RNA, 1617 nt, Artificial Sequence
  derived and/or modified sequence opt1 from VP1__Norovirus_and/or_Norovirus-like__KC175385
augaagauggccagcuccgacgccaaccccagcaacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgagcucccacaacuacaccaugaaccuggccagccagaacuggaacagcuacgaccccaccgaggagauccccgcgccccugggcacgccggacuucgucgggaagauccagggcgugcucacccagaccacccgcacggacggguccacccggggccacaaggccaccguguacaccgggagcgccgacuucucccccaagcugggccgcguccaguucgccacggacaccgacaacgacuuccagaccaaccagaacaccaaguucacgcccgugggcgugauccaggacgggagcaccacgccccggaacgagccgcagcaguggguccugcccuccuacagcggccgcaacauccacaacgugcaccucgcccccgccguggcccccaccuucccgggggagcagcugcuguucuuccgguccaccaugcccggcugcagcggguaccccaacauggaccucgacugccugcugccccaggaguggguccaguacuucuaccaggaggcggccccggcccaguccgacguggcccuccugcgcuucgugaaccccgacaccggccggguccuguucgagugcaagcuccacaagagcggcuacgugaccguggcgcacaccgggcagcacgaccuggucaucccgcccaacggcuacuuccgcuucgacuccugggugaaccaguucuacacccuggcccccauggggaacggcacggggcggcgccgcuga

SEQ ID NO: 12393 - RNA, 1617 nt, Artificial Sequence
  derived and/or modified sequence opt1 from VP1__Norovirus_and/or_Norovirus-like__JQ613563
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaugaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaccccgggcagccacaacuacaccaugaaccuggccucccagaacuggaacagcuacgaccccacggaggagauccccgcgccccuggggaccccggacuucgucggcaagauccagggggugcucacccagaccacgcgcaccaacggcagcacccgggggcacaaggccaccguguacacgggcuccgccgacuucagccccaagcugggccgcguccaguucgccaccgacaccgacaacgacuucgagaccaaccagaacacgaaguucacccccgugggggugauccaggacggcuccaccacgccccggaacgagccgcagcaguggguccugcccagcuacuccgggcgcaacauccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacgcuggcccccaugggcaacgggaccggccggcgccgcuga

SEQ ID NO: 12394 - RNA, 1617 nt, Artificial Sequence
  derived and/or modified sequence opt1 from VP1__Norovirus_and/or_Norovirus-like__JQ613558
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaucggccaguacgaccuggucaucccgcccaacggguacuuccgguucgacagcugggugaaccaguucuacacccuggcccccaugggcaacgggaccggccgccgccgguga

SEQ ID NO: 12395 - RNA, 1617 nt, Artificial Sequence
  derived and/or modified sequence opt1 from VP1__Norovirus_and/or_Norovirus-like__GQ856451
augaagauggccagcaacgacgccaaccccuccgacggcagcguggcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaugaucguggacgugcggcagcuggagcccguccucaucccgcugcccgacgugcgcaacaacuucuaccacuacaaccagagcaacgacuccaccaucaagcugaucgccaugcucuacacgccccugcgggccgacaacgcgggcgaggacguguucaccgucagcugccgcgugcugacccggcccuccccggacuucgacuucaucuuccucgugccgcccaccgucgagagcaagaccaagcccuucacggugcccauccugaccguggaggagaugaccaacucccgcuuccccaucccccuggagaagcuguucaccggccccagcuccacguucgucgugcagccgcagaacgggcggugcaccaccgacggcguccugcuggggaccacgcagcucagccccgugaacaucugcaccuuccgcggcgacgugacccacaucgccggcucccggaacuacaccaugaaccuggccagccugaacuggaacaacuacgaccccacggaggagaucccggcgccccucgggacccccgacuucgucggcaagauccagggggugcugacccagaccacgaagggcgacggguccacccgcggccacaaggccaccguguacaccggcagcgcccccuucacgccgaagcuggggagcguccaguucuccaccgacaccgagaacgacuucgagacccaccagaacacgaaguucacccccgugggcgugauccaggacgggagcaccacccaccggaacgagccccagcaguggguccuccccuccuacagcggccgcaacgugcacaacgugcaccuggccccggccgucgcccccacguuccccggggagcagcuccucuucuuccgguccaccaugcccggcugcagcggcuacccgaacauggaccuggacugccugcucccccaggagugggugcagcacuucuaccaggaggccgcgcccgcccaguccgacguggcccugcugcgcuucgucaaccccgacaccgggcggguccucuucgagugcaagcugcacaagagcggcuacgugaccguggcccacaccgggcagcacgaccuggugaucccgcccaacggcuacucccgcuucgacagcugggugaaccaguucuacacgcucgcgcccauggggaacggcaccggccggcgccgguga

SEQ ID NO: 12396 - RNA, 1617 nt, Artificial Sequence
  derived and/or modified sequence opt1 from VP1__Norovirus_and/or_Norovirus-like__DQ419908
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcuggacuccgugcaguucgccaccgacaccgacaacgacuucgagacggggcagaacacccgguucacccccgucggcgugauccaggacgggagcuccgcccaccgcaacgagccccagcagugggugcugcccgacuacagcggccggaccguccacaacgugcaccucgccccggccguggcccccacguuccccggggagcagcugcuguucuuccgcuccaccaugcccggcugcagcggcuacccgaacauggaccucgacugccugcugccccaggaguggguccagcacuucuaccaggaggcggcccccucccagagcgacguggcccuccugcgguucgugaaccccgacaccgggcgcguccuguucgagugcaagcuccacaaggccggcuacgugaccguggcgcacaccgggcagcacgaccuggucaucccgcccaacggcuacuuccgguucgacuccugggugaaccaguucuacacgcuggcccccauggggaacggcgccggccgccgccgguga

SEQ ID NO: 12397 - RNA, 1617 nt, Artificial Sequence
  derived and/or modified sequence opt1 from VP1__Norovirus_and/or_Norovirus-like__KX514354
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccgugcaggagaugacgaacucccgguuccccgccacccuggacaagcuguucaccggccccagcuccacccucgucgugcagccccagaacgggcgcugcaugaucgacggcguccugcucgggacgacccagcugagcccggugaacaucugcaccuuccggggcgacgugacccacucccgcgacagcacgaucuacaccaugaaccuggccagccccaacuggaacaacuacgaccccaccgaggagaucccggcgccccucggcacccccgacuucgucgggaagauccagggcgugcugacgcagaccaccaagggggagggcuccacccgggggcaccgcgccacgguguacgucggcagcgccaacuacacccccaagcugggcaaggugcaguucgagaccaacaccacgaacgaccucuacgcccaccagaacacccgguucaccccggugggggucgugcagggcggggaguccgcccaccgcagcgagccccagcagugggugcugcccuccuacagcggccgggacacccccaacguccaccuggccccggcgguggcccccacguuccccggggagcagcuccuguucuuccgcuccaccauccccggcugcggcgggcacccgaacauggaccuggacugccuccugccccaggagugggugcagcacuucuaccaggaggccgcccccgcgcagagcgacgucgcccugcuccgguucgugaaccccgacaccucccgcgugcuguucgagugcaagcugcacaagagcggcuacgucaccguggcccacacggggcagcacgaccucgugaucccgcccaacggcuacuuccgguucgacuccugggucaaccaguucuacacccuggcccccauggggaacggcaccggccgcaagcgcuga

SEQ ID NO: 12398 - RNA, 1617 nt, Artificial Sequence
  derived and/or modified sequence opt1 from VP1__Norovirus_and/or_Norovirus-like__KX354062
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccaacucccacaacuacaccaugaaccuggccagccagaacuggaacagcuacgacccgaccgaggagauccccgcgccccugggcacgcccgacuucguggggaagauccagggcguccucacccagaccaccuccacgaacgggagcacccgcggccacaaggccaccguguacaccggguccgccgacuucagcccgaagcugggccgggugcaguucgccacggacaccaacaacgacuucgagaccaaccagaacaccaaguucacgcccgucggcgugauccaggacggguccaccacgccccgcaacgagccccagcagugggugcugccgagcuacuccggccggaacauccacaacguccaccucgcccccgccguggcccccaccuuccccggggagcagcugcuguucuuccgcagcaccaugccgggcugcuccggguaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggcuacgucaccguggcgcacaccgggcagcacgaccuggugaucccgcccaacggcuacuuccgguucgacagcugggucaaccaguucuacacccuggcccccauggggaacggcacggggcgccggcgcuga

SEQ ID NO: 12399 - RNA, 1617 nt, Artificial Sequence
  derived and/or modified sequence opt1 from VP1__Norovirus_and/or_Norovirus-like__AB972532
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgaccccaccgaggagaucccggcgccccuggggacgcccgacuucgugggcaagauccaggggguccucacccagaccacccggacggacggcuccacccgcgggcacaaggccaccguguacaccggcagcgccgacuucgcccccaagcugggccgggugcaguucgagacggacaccgaccacgacuucgaggccaaccagaacaccaaguucaccccggucggggugauccaggacggcuccacgacccaccgcaacgagccccagcagugggugcugcccagcuacuccgggcggaacacccccaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgguga

SEQ ID NO: 12400 - RNA, 1617 nt, Artificial Sequence
  derived and/or modified sequence opt1 from VP1__Norovirus_and/or_Norovirus-like__KT202796
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggacgccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12401 - RNA, 1617 nt, Artificial Sequence
  derived and/or modified sequence opt1 from VP1__Norovirus_and/or_Norovirus-like__AB933751
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaacaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggccgccgccgguga

SEQ ID NO: 12402 - RNA, 1617 nt, Artificial Sequence
  derived and/or modified sequence opt1 from VP1__Norovirus_and/or_Norovirus-like__KM514078
augaagauggccagcuccgacgccaaccccagcgacggcuccgcggccaaccuggugcccgaggucaacaacgaggugcucgcccuggagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccgcaacuacaccaugaaccuggccucccagaacuggagcaacuacgacccgaccgaggagauccccgcgccccucgggacgcccgacuucgugggcaagauccaggggaugcugacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcuccccuccuacagcgggcggaacaccccgaacgugcaccuggcccccgcggucgcccccaccuuccccggcgagcagcuccuguucuuccgcuccacgaugccggggugcagcggcuaccccaacauggaccuggacugccugcucccccaggagugggugcaguacuucuaccaggaggccgcccccgcgcaguccgacguggcccugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacgggacgggccgccgccgguga

SEQ ID NO: 12403 - RNA, 1617 nt, Artificial Sequence
  derived and/or modified sequence opt1 from VP1__Norovirus_and/or_Norovirus-like__KM198569
augaagauggccagcaacgacgccaaccccuccgacggcagcgcggccaaccuggugccggaggucuccaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaagaucaucuucgccgccgugccgcccaacuucccgacggaggggcugucccccagccaggugaccauguucccccacaucaucguggacguccggcagcuggagcccgugcucaucccgcugcccgacgugcgcaacaacuucuaccacuacaaccagaccaacgacuccaccaucaagcugaucgcgaugcucuacacgccccugcgggccaacaacgccggcgaggacgucuucaccgugagcugccgcgugcugacccggcccuccccggacuucgacuucaucuuccucgucccgcccaccguggagagccgcacgaagcccuucaccgugcccauccugaccgucgaggagaugaccaacucccgguuccccaucccccuggagaagcuguucacgggccccagcggggccuucguggugcagccgcagaacggccgcugcaccaccgacgggguccugcugggcaccacgcagcucucccccgugaacaucugcaccuuccggggcgacgucacccacaucgccgggagccgcaacuacaccaugaaccuggcgucccugaacuggaacaacuacgaccccacggaggagaucccggcgccccucggcacccccgacuucguggggaagauccagggcgugcugacccagaccacgaagggggacggcagcacccggggccacaaggccaccgucuacaccggguccgcccccuucacgccgaagcugggcagcgugcaguucagcaccgacaccgagaacgacuucgagacccaccagaacacgaaguucacccccgugggggucauccaggacggcgggaccacccaccgcaacgagccccagcagugggugcuccccuccuacagcggccgggacgugcacaacguccaccuggccccggccguggcccccacguuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcuga

SEQ ID NO: 12404 - RNA, 1617 nt, Artificial Sequence
  derived and/or modified sequence opt1 from VP1__Norovirus_and/or_Norovirus-like__KF768522
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugauccacaucagcggcucccgcaacuacaccaugaaccuggccagccagaacuggaacagcuacgacccgaccgaggagauccccgcgccccuggggacccccgacuucgucggcaagauccagggggugcucacgcagaccacccggaccaacggcuccacgcgcgggcacaaggccaccguguacaccggcagcgccgacuucuccccgaagcugggccggguccaguucgccaccgacacggacaacgacuucgagaccaaccagaacaccaaguucacccccgugggggugauccaggacggcagcacgacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggaccggccgccgccgguga

SEQ ID NO: 12405 - RNA, 1617 nt, Artificial Sequence
  derived and/or modified sequence opt1 from VP1__Norovirus_and/or_Norovirus-like__KF060120
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccuguggaacgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggaagugcacgaccgacggcguccuccuggggaccacccagcucagccccgugaacaucugcacguuccgcggcgacgugacccacaucccgggcucccggaacuacaccaugaaccuggccagccagaacuggaacuccuacgaccccaccgaggagauccccgcgccccuggggacgccggacuucgucggcaagauccagggggugcucacccagaccacccgcacgaacggcagcacccgggggcacaaggccaccguguacaccggcagcgccgacuucucccccaagcugggccgcguccaguucgccacggacaccgacaacgacuucgagaccaaccagaacaccaaguucacgcccgugggggugauccaggacggcagcaccacgccccggaacgagccgcagcaguggguccugcccuccuacagcgggcgcaacauccacaacgugcaccucgcccccgccguggcccccaccuucccgggcgagcagcugcuguucuuccgguccaccaugcccgggugcagcggcuaccccaacauggaccucgacugccugcugccccaggaguggguccaguacuucuaccaggaggcggccccggcccaguccgacguggcccuccugcgcuucgugaaccccgacaccggccggguccuguucgagugcaagcuccacaagagcggguacgugaccguggcgcacaccggccagcacgaccuggucaucccgcccaacggguacuuccgcuucgacuccugggugaaccaguucuacacccuggcccccaugggcaacgggacgggccggcgccgcuga

SEQ ID NO: 12406 - RNA, 1617 nt, Artificial Sequence
  derived and/or modified sequence opt1 from VP1__Norovirus_and/or_Norovirus-like__KF060102
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcaacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaucggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgccccggcgguggcccccaccuuccccggggagcagcugcuguucuuccgcuccaccaugcccggcugcagcggcuacccgaacauggaccucgacugccugcugccccaggagugggugcaguacuucuaccaggaggccgcccccgcgcaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgguga

SEQ ID NO: 12407 - RNA, 1617 nt, Artificial Sequence
  derived and/or modified sequence opt1 from VP1__Norovirus_and/or_Norovirus-like__KF060088
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccaggggaugcucacccagaccacccggacggacggcuccacccgcgggcacaaggccaccguguacaccggcagcgccgacuucuccccgaagcugggccgggugcaguucgccacggacaccgacaacgacuucgucaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgguga

SEQ ID NO: 12408 - RNA, 1617 nt, Artificial Sequence
  derived and/or modified sequence opt1 from VP1__Norovirus_and/or_Norovirus-like__KF060025
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucguggccgaccagaacaccaaguucacccccgugggggucauccaggacggcagcacgacgccccgcaacgagccccagcagugggugcugccguccuacagcgggcggaacacccacaacgugcaccucgcccccgccgucgcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacguggcgcuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgguga

SEQ ID NO: 12409 - RNA, 1617 nt, Artificial Sequence
  derived and/or modified sequence opt1 from VP1__Norovirus_and/or_Norovirus-like__KC517378
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugggcaacaacuucuaccacuacaaccaguccaacgaccccaccaucaagcugaucgccaugcucuacacgccccugcgcgcgaacaacgccggcgacgacgucuucaccgugagcugccgggugcugacccgcccgucccccgacuucgacuucaucuuccucgucccgcccaccguggagagccggaccaagcccuucuccgugcccguccugacgguggaggagaugaccaacagccgcuuccccaucccccuggagaagcuguucaccgggccguccagcgccuucgucgugcagccccagaacggccggugcaccacggacggggugcuccugggcaccacccagcucucccccgucaacaucugcaccuuccgcggcgacgugacgcacaucaccgggagccggaacuacaccaugaaccuggccucccagaacuggaacaacuacgacccgaccgaggagauccccgcgccccugggcacgcccgacuucguggggaagauccagggcguccucacccagaccacccgcacggacgggagcacccggggccacaaggccaccguguacaccggcagcgccgacuucgccccgaagcuggggcgcgugcaguucgagacggacaccgaccacgacuucgaggccaaccagaacaccaaguucacccccgucggcgugauccaggacgggggcacgacccaccggaacgagccccagcagugggugcugcccuccuacagcgggcgcaacacccacaacguccaccucgccccggcgguggcccccaccuuccccggcgagcagcugcuguucuuccgguccacgaugcccggcugcagcggguacccgaacauggaccucgacugccugcugccccaggagugggugcaguacuucuaccaggaggccgcccccgcgcaguccgacgucgcccuccugcgcuucgugaaccccgacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacggcacggggcggcgccgcuga

SEQ ID NO: 12410 - RNA, 1617 nt, Artificial Sequence
  derived and/or modified sequence opt1 from VP1__Norovirus_and/or_Norovirus-like__JX459640
augaagauggccagcuccgacgccaaccccagcgacggcuccaccgcgcaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12411 - RNA, 1617 nt, Artificial Sequence
  derived and/or modified sequence opt1 from VP1__Norovirus_and/or_Norovirus-like__JQ613512
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccggggccuucgugguccagccgcagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcagcgugcaguucuccaccgacaccgagaacgacuucgagacccaccagaacacgaaguucacccccgucggggugauccaggacggcagcaccacccaccgcaacgagccccagcagugggugcuccccuccuacagcgggcggaacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacgccugggugaaccaguucuacacgcucgcccccaugggcaacggcaccgggcgcaagcgguga

SEQ ID NO: 12412 - RNA, 1617 nt, Artificial Sequence
  derived and/or modified sequence opt1 from VP1__Norovirus_and/or_Norovirus-like__HQ005299
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggccgcgccggcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacgggacgggccgccgccgguga

SEQ ID NO: 12413 - RNA, 1617 nt, Artificial Sequence
  derived and/or modified sequence opt1 from VP1__Norovirus_and/or_Norovirus-like__AB541312
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacugcauccucgaccugccgcccaccguggagagccgcacgaagcccuucuccgugcccauccugaccgucgaggagaugaccaacagccgguuccccaucccccucgagaagcuguucaccggcccguccagcgccuucguggugcagccccagaacgggcgcugcacgaccgacggcguccugcucgggaccacccagcugucccccgugaacaucugcacguuccggggcgacgucacccacaucaccggcagccgcaacuacaccaugaaccuggccacgcagaacuggaacuccuacgacccgaccgaggagauccccgcgccccucgggacccccgacuucgugggcaagauccagggggugcugacccagacgacccgggccgacggcagcacccgcgggcacaaggccaccgucuacacgggcagcgccgacuucgccccgaagcugggccgggugcaguucgccaccgacaccgacaacgacuucgacgccaaccagaacaccaaguucacgcccgugggggucauccaggacggcgacaccgcgcaccgcaacgagccccagcagugggugcuccccuccuacagcgggcggaacucccacaacgugcaccuggccccggccgucgcccccaccuuccccggcgagcagcuccucuucuuccgcagcaccaugcccgggugcuccggcuacccgaacauggaccuggacugccugcucccccaggagugggugcaguacuucuaccaggaggcggcccccgcccagagcgacguggcccugcugcgguucgucaaccccgacacgggccgcgugcuguucgagugcaagcugcacaaguccggguacgugaccgucgcccacaccggccagcacgaccuggugaucccgcccaacggguacuuccgguucgacagcugggugaaccaguucuacacccucgcgcccaugggcaacgggaccggccgccgccgguga

SEQ ID NO: 12414 - RNA, 1617 nt, Artificial Sequence
  derived and/or modified sequence opt1 from VP1__Norovirus_and/or_Norovirus-like__AB541275
augaagauggccagcuccgacgccaacccgcccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccccgcugggccccgaccucaaccccuaccugucccaccuggcccgcauguacaacggcuacgccgggggcuucgaggugcaggucauccucgccgggaacgcguucaccgccggcaagaucaucuucgccgccgugcccccgaacuuccccacggaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggggccuucgugguccagccccagaacggccgcugcacgaccgacggggugcugcugggcaccacccagcucucccccgucaacaucugcacguuccggggcgacgugacccacaucgccgggagccgcuccuacaccaugaaccuggccagccugaacuggaacaacuacgacccgaccgaggagauccccgcgccccucggcacgcccgacuucguggggaagauccagggcaugcugacccagaccaccaagggggacggcuccacgcggggccacaaggccaccgucuacaccgggagcgccccguucacccccaagcugggcagcgugcaguucuccacggacaccgagaacgacuuccagacccaccagaacaccaaguucacgcccgugggggucauccaggacggcagcaccacccaccgcaacgagccccagcagugggugcucccguccuacagcgggcgggacgugcacaacguccaccuggcccccgccguggcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcuga

SEQ ID NO: 12415 - RNA, 1617 nt, Artificial Sequence
  derived and/or modified sequence opt1 from VP1__Norovirus_and/or_Norovirus-like__AB303930
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucgugcucgccgggaacgccuucaccgcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaaccuguaccacuacaaccagagcaacgaccccacgaucaagcucaucgccaugcuguacacgccccugcgggccaacaacgcgggcgaggacguguucaccgucuccugccgcgugcucacccggccgagccccgacuucgacuucaucuuccuggugccgcccaccgucgagucccgcaccaagcccuucaccgugcccauccugaccggcgaggagaugacgaacagccgguuccccaucccccucgagaagcuguucaccgggccguccggcgccuucgugguccagccccagaacgggcgcugcaccaccgacggcgugcugcucggcacgacccagcugcugcccgucaacaucugcaccuuccgcggggacgugacccacaucgccggcacgcacaacuacaccaugaaccucgccagccagaacuggaacaacuacgacccgaccgaggagauccccgcgccccuggggacccccgacuucgugggccggauccaggggaugcugacgcagaccacccggggcgacggcuccacccgcgggcacaaggccacggucagcaccggcgacgugcacuucaccccgaagcucggguccauccaguucaacaccgacacgaacaacgacuucgagaccggccagaacaccaaguucacccccgugggggucgugcaggacggcaacggcacgcaccagaacgagccccagcagugggugcugcccagcuacuccgggcggaccagccacaacguccaccuggccccggccguggcccccaccuuccccggcgagcagcuccuguucuuccgcagcaccaugcccgggugcuccggcuacccgaacaugaaccuggacugccuccugccccaggagugggugcagcacuucuaccaggaggccgcgcccgcccagagcgacgucgcccugcuccgguucgugaaccccgacaccgggcgcgugcuguucgagugcaagcugcacaaguccggcuacgucacgguggcccacaccggccagcacgaccucgugaucccgcccaacggguacuuccgguucgacagcugggucaaccaguucuacacccuggcgcccaugggcaacgggaccggccgccggcgcuga

SEQ ID NO: 12416 - RNA, 1617 nt, Artificial Sequence
  derived and/or modified sequence opt1 from VP1__Norovirus_and/or_Norovirus-like__AY485642
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugccccaccuggcccgcauguacaacggcuacgccgggggcuucgaggugcaggucauccucgccgggaacgccuucacggcgggcaagaucaucuucgccgccgugcccccgaacuuccccaccgaggggcugucccccagccaggugaccauguucccccacaucaucgucgacgugcggcagcuggagccggugcucaucccccugcccgacguccgcaacaacuucuaccacuacaaccaguccaacgaccccaccaucaagcugaucgccaugcucuacacgccgcugcgggccaacaacgcgggcgaggacguguucaccgugagcugccgcguccugacccggcccucccccgacuucgacuucaucuuccucgugcccccgaccguggagagccgcacgaagcccuucaccguccccauccugaccguggaggagaugaccaacucccgguuccccaucccgcuggagaagcuguucacgggccccagcggggccuucgugguccagccccagaacggccgcugcaccaccgacggggugcuccugggcaccacgcagcucuccccggucaacaucugcaccuuccggggcgacgugacccacaucgccgggacccacaacuacacgaugaaccuggccagccagaacuggaacaacuacggccccaccgaggagauccccgcgccccuggggaccccggacuucgugggccgcauccaggggaugcucacccagacgacccggggcgacggcuccacccgcgggcacaaggccaccgucagcacgggcgacgugcacuucacccccaagcugggguccauccaguucaacaccgacaccaacaacgacuucgagacgggccagaacaccaaguucacccccgugggggucgugcaggacggcaacggcacccaccagaacgagccccagcagugggugcugccgagcuacuccgggcggacgggccacaacguccaccucgcccccgccguggcccccaccuuccccggggagcagcugcuguucuuccgcagcaccaugccgggcugcagcggguaccccaacaugaaccucgacugccugcugccccaggagugggugcagcacuucuaccaggaggccgcgcccgcccaguccgacgucgcccuccugcgguucgugaacccggacaccggccgcgugcuguucgagugcaagcuccacaagagcggcuacgucaccguggcccacacggggcagcacgaccuggugaucccgcccaacggcuacuuccgguucgacuccugggucaaccaguucuacacccuggcgcccauggggaacggcaccggccgccggcgcuga

SEQ ID NO: 12417 - RNA, 1617 nt, Artificial Sequence
  derived and/or modified sequence opt1 from VP1__Norovirus_and/or_Norovirus-like__KX514343
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcggaccaacaacgcgggcgacgacguguucaccgugagcugccgcguccugacccggcccuccccggacuucgacuucaucuuccucgugccgcccaccguggagagccgcuccaagcccuucagcguccccgugcugacgguggaggagaugaccaacucccgguuccccgccacccuggacaagcuguucaccggccccagcuccacguucgucgugcagccccagaacgggcgcugcaugaucgacggcguccugcuggggaccacccagcucagcccggugaacaucugcaccuuccggggcgacgugacgcaguccggcaacaccaagaucuacaccaugaaccuggccagccccaacuggaacaacuacgaccccaccgaggagaucccggcgccccuggggacgcccgacuucgucggcaagauccaggggaugcucacccagaccaccaagggcgaggggagcacgcgcggccaccgggccaccguguacgugggcuccgccaacuacgcccccaagcuggggcgcguccaguucgagaccgacaccacggacgaccuggacgcccaccagaacaccaaguucaccccggugggcgugguccagagcggggagucccccaagggcagcgagccccagcagugggugcuccccuccuacagcgggcgggacaccccgaacgugcaccuggcccccgccgucgcgcccacguuccccggcgagcagcuccucuucuuccgcuccaccaucccgggcugcgggggccaccccaacaugaaccuggacugccugcucccccaggagugggugcagcacuucuaccaggaggccgcccccgcccagagcgacguggcgcugcugcgguucgucaacccggacaccucccgcguccucuucgagugcaagcugcacaagagcggguacgugaccguggcccacacgggccaguacgaccuggugcuccccuccaacggguacuuccgguucgacagcugggugaaccaguucuacacccuggcccccaugggcaacggcaccgggcgccggcgcuga

SEQ ID NO: 12418 - RNA, 1617 nt, Artificial Sequence
  derived and/or modified sequence opt1 from VP1__Norovirus_and/or_Norovirus-like__KX514274
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgucacccuggacaagcuguucaccggccccagcuccaccaucgugguccagccccagaacgggcgcugcacgaucgacggcgugcugcuggggaccacccagcucagcccggugaacaucugcaccuuccggggcgacgucacgcacccccgcgacuccaccaucuacaccaugaaccuggccagccccaacuggaacaccuacgacccgacggaggagauccccgcgccccugggcacccccgacuucguggggaagauccagggcaugcucacccagaccacgaagggggccggcagcacccgggggcaccgcgccaccguguacgucggcuccgccaacuacgccccgaagcugggccgggugcaguucgagaccaacacgagcgacgaccuggacgcccaccagaacaccaaguucacccccgugggggucauccagggcggggaguccgcccaccgcagcgagccccagcagugggugcuccccuccuacagcggccgggacaucccgaacgugcaccuggcgcccgccgucgcccccaccuuccccggggagcagcuccucuucuuccgcuccacgaucccgggcugcggcgggcaccccaacauggaccuggacugccugcucccccaggagugggugcagcacuucuaccaggaggccgcgcccgcccagagcgacguggcccugcugcgguucgucaacccggacaccucccgcguccucuucgagugcaagcugcacaagagcggcuacgugaccguggcccacaccgggcagcacgaccuggugaucccgcccaacggcuacuuccgguucgacuccugggugaaccaguucuacacgcucgcccccauggggaacggcaccggccgcaagcgcuga

SEQ ID NO: 12419 - RNA, 1617 nt, Artificial Sequence
  derived and/or modified sequence opt1 from VP1__Norovirus_and/or_Norovirus-like__KX514175
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacuccaagaucuacacgaugaaccuggccagccccaacuggaacaacuacgacccgaccgaggagauccccgcgccccugggcacccccgacuucgucgggaagauccagggcaugcucacccagacgaccaagggggagggcagcacccgggggcaccgcgccaccguguacgugggcuccgccaacuacgccccgaagcugggccggguccaguucgagacggacaccaccgacgaccuggacgcccaccagaacaccaaguucacgcccgugggggugguccagggcggggagagccccaagggcuccgagccccagcagugggugcucccgagcuacuccggggccaacaccuucaacgugcaccuggcgcccgccgucgcccccaacuuccccggcgagcagcuccucuucuuccgcagcacccugccgggcugcgggggccaccccaacauggaccuggacugccuccugccccaggagugggugcagcacuucuaccaggaggccgcgcccgcccaguccgacguggcccugcuccgguucgucaacccggacaccagccgcgugcuguucgagugcaagcugcacaaguccggguacgugacggucgcccacaccggccagcacgaccucgugaucccgcccaacggguacuuccgguucgacagcugggugaaccaguucuacacccuggcccccaugggcaacggcaccgggcgcaagcgguga

SEQ ID NO: 12420 - RNA, 1617 nt, Artificial Sequence
  derived and/or modified sequence opt1 from VP1__Norovirus_and/or_Norovirus-like__KX354093
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggagcuccuacgacccgaccgaggagauccccgcgccccuggggacgcccgacuucgugggcaagauccaggggguccucacccagaccaccagcacgaacggcuccacccgcgggcacaaggccaccguguacaccggcagcgccgacuucuccccgaagcugggccgggugcaguucgccacggacaccaacaacgacuucgagaccaaccagaacaccaaguucacgcccgucggggugauccaggacggcagcaccacgccccgcaacgagccccagcagugggugcugccguccuacagcgggcggaacauccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacccuggcccccaugggcaacgggacgggccgccggcgcuga

SEQ ID NO: 12421 - RNA, 1617 nt, Artificial Sequence
  derived and/or modified sequence opt1 from VP1__Norovirus_and/or_Norovirus-like__KX354003
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgguga

SEQ ID NO: 12422 - RNA, 1617 nt, Artificial Sequence
  derived and/or modified sequence opt1 from VP1__Norovirus_and/or_Norovirus-like__KR131778
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccgaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacgggaccggccgccgccgguga

SEQ ID NO: 12423 - RNA, 1617 nt, Artificial Sequence
  derived and/or modified sequence opt1 from VP1__Norovirus_and/or_Norovirus-like__AB972468
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgaccccaccgaggagaucccggcgccccuggggacgcccgacuucgugggcaagauccaggggguccucacccagaccacccggacggacggcuccacccgcgggcacaaggccaccguguacaccggcagcgccgacuucgugcccaagcugggccggguccaguucgagacggacaccgaccgcgacuucgaggccaaccagaacaccaaguucaccccggugggggugauccaggacggcuccacgacccaccggaacgagccccagcaguggguccugcccagcuacuccgggcgcaacacccccaacgugcaccucgccccggccguggcgcccaccuuccccggcgagcagcugcuguucuuccggagcacgaugcccgggugcuccggcuacccgaacauggaccucgacugccugcugccccaggaguggguccaguacuucuaccaggaggccgcccccgcccagagcgacguggcgcuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccaguucuacacccuggcccccaugggcaacgggacgggccgccggcgcuga

SEQ ID NO: 12424 - RNA, 1617 nt, Artificial Sequence
  derived and/or modified sequence opt1 from VP1__Norovirus_and/or_Norovirus-like__KR904222
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacugcgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgguga

SEQ ID NO: 12425 - RNA, 1617 nt, Artificial Sequence
  derived and/or modified sequence opt1 from VP1__Norovirus_and/or_Norovirus-like__KP244320
augaagauggccagcuccgacgccaaccccagcgacggcuccaccgcgaaccuggugccggaggucaacaacgaggugauggcccucgagcccguggucggggccagcaucgccgcccccguggcgggccagcagaacgugaucgaccccuggauccgcaacaacuucguccaggcccccgggggcgaguucaccgugagcccccggaacgcccccggggagauccugugguccgcgccccugggcccggaccucaaccccuaccugccccaccuggcccgcauguacaacggcuacgccgggggcuucgaggugcaggucauccucgccgggaacgccuucacggccggcaagaucaucuucgcggccgugcccccgaacuuccccaccgaggggcugucccccagccaggugaccauguucccccacaucaucgucgacgugcggcagcuggagccggugcucaucccccugcccgacguccgcaacaacuucuaccacuacuaccaguccaacgaccccaccaucaagcugaucgccaugcucuacacgccgcugcgggccaacaacgccggcgacgacguguucaccgugagcugccgcguccugacccggcccucccccgacuucgacuucaucuuccucgugcccccgaccguggagagccgcacgaagcccuucuccguccccgugcugaccguggaggagaugaccaacagccgguuccccaucccgcuggagaagcuguucaccggccccuccagcgcguucgucgugcagccccagaacgggcgcugcacgaccgacggcguccuccuggggaccacccagcucuccccggugaacaucugcacguuccggggcgacgugacccacaucagcggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagucccagcaguggguccugccgagcuacuccgggcggaacacccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggccgcgcccgcccagagcgacguggcccuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacgcuggcgcccaugggcaacgggaccggccgccgccgguga

SEQ ID NO: 12426 - RNA, 1617 nt, Artificial Sequence
  derived and/or modified sequence opt1 from VP1__Norovirus_and/or_Norovirus-like__KP244315
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgugguccaggugauccucgccgggaacgccuucacggcgggcaagaucaucuucgccgccgugccgcccaacuucccgaccgaggggcugagccccucccaggucaccauguucccccacaucaucguggacgcccggcagcuggagcccgugcucaucccgcugcccgacguccgcaacaacuucuaccacuacaaccagagcaacgaccccaccaucaagcugaucgccaugcucuacacgccccugcgggcgaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccaccaagacggacggcagcacccgggggcacaaggccaccguguacaccggcuccgccgacuucagcccgaagcugggccgcguccaguucgccacggacaccgacaacgacuucgagaccaaccagaacaccaaguucacgcccgugggggugauccaggacggcuccaccacgccccggaacgagccccagcaguggguccugccgagcuacuccgggcgcaacacccacaacgugcaccucgcccccgccguggcgcccaccuuccccggcgagcagcugcuguucuuccggagcaccaugccggggugcuccggcuaccccaacauggaccucgacugccugcugccccaggaguggguccaguacuucuaccaggaggccgcccccgcccagagcgacguggcgcuccugcgcuucgugaacccggacaccggccggguccuguucgagugcaagcuccacaaguccggguacgugaccguggcccacaccggccagcacgaccuggucaucccgcccaacggguacuuccgcuucgacagcugggugaaccaguucuacacgcuggcccccaugggcaacgggaccggccggcgccgcuga

SEQ ID NO: 12427 - RNA, 1617 nt, Artificial Sequence
  derived and/or modified sequence opt1 from VP1__Norovirus_and/or_Norovirus-like__KP244314
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgugggcggguucgagguccaggugauccucgccgggaacgccuucacggccggcaagaucaucuucgcggccgugccgcccaacuucccgaccgaggggcugucccccagccaggucaccauguucccccacaucaucguggacgugcggcagcuggagcccguccucaucccgcugcccgacgugcgcaacaacuuccaccacuacaaccaguccaacgaccccaccaucaagcugaucgccaugcucuacacgccccugcgggccaacaacgccggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgcguucgugguccagccccagaacgggcgcugcacgaccgacggcgugcuccuggggaccacccagcucucccccgugaacaucugcacguuccggggcgacgucacccacaucccgggcagccgcaacuacaccaugaaccuggccucccagaacuggaacagcuacgaccccaccgaggagauccccgcgccccuggggacgccggacuucgugggcaagauccagggggugcucacccagaccacccggacgaacggcagcacccgcgggcacaaggccaccgucuacaccggcuccgccgacuucagccccaagcugggccggauccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacacccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggccgcgccggcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacgcuggcgcccaugggcaacgggaccggccgccgccgguga

SEQ ID NO: 12428 - RNA, 1617 nt, Artificial Sequence
  derived and/or modified sequence opt1 from VP1__Norovirus_and/or_Norovirus-like__KM268078
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgaccccaccgaggagaucccggcgccccuggggacgcccgacuucgugggcaagauccaggggguccucacccagaccacccggacggacggcuccacccgcgggcacaaggccaccguguacaccggcagcgccgacuucgcccccaagcugggccgggugcaguucgagacggacaccgaccacgacuucgaggccaaccagaacaccaaguucaccccggucggggugauccaggacggcgggacgacccaccgcaacgagccccagcagugggugcugcccuccuacagcggccggaacacccccaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgguga

SEQ ID NO: 12429 - RNA, 1617 nt, Artificial Sequence
  derived and/or modified sequence opt1 from VP1__Norovirus_and/or_Norovirus-like__KM198555
augaagauggccagcuccgacgccaaccccagcgacggcuccaccgcgagccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucgugcucgccgggaacgccuucacggcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgacgacguguucaccgucuccugccgcgugcugacccggccgagccccgacuucgacuucaucuuccucgugccgcccaccgucgagucccgcacgaagcccuucagcgugcccgugcugaccgucgaggagaugaccaacucccgguuccccaucccccuggagaagcuguucaccggcccgagcuccgccuucgugguccagccccagaacgggcgcugcacgaccgacggcgugcuccuggggaccacccagcucagccccgugaacaucugcacguuccggggcgacgucacccacaucuccggcagccgcaacuacaccaugaaccuggccagccaguccuggaacagcuacgacccgaccgaggagauccccgcgccccuggggucccccgacuucgugggcaagauccagggggugcucacgcagaccacccggaccaacggcagcacgcgcgggcacaaggccaccgucuacaccggcuccgccgacuucagcccgaagcugggccgggugcaguucgccaccgacacggacaacgacuucgagaccaaccagaacaccaaguucacccccgugggggucauccaggacggcuccacgacgccccgcaacgagccccagcagugggugcugccgagcuacuccgggcggaacauccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggaccggccgccgccgguga

SEQ ID NO: 12430 - RNA, 1617 nt, Artificial Sequence
  derived and/or modified sequence opt1 from VP1__Norovirus_and/or_Norovirus-like__KF060115
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaagcccggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12431 - RNA, 1617 nt, Artificial Sequence
  derived and/or modified sequence opt1 from VP1__Norovirus_and/or_Norovirus-like__KF060018
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacggccgcugcacgaccgacgggguccuccugggcaccacccagcucagccccgugaacaucugcacguuccgcggggacgugacccacaucuccggcagccggaacuacaccaugaaccuggccagccagaacuggaacuccuacgacccgaccgaggagauccccgcgccccugggcacgcccgacuucgucgggaagauccagggcgugcucacccagaccacccggacggacgggagcacccgcggccacaaggccaccguguacaccggguccgccgacuucagcccgaagcugggccggguccaguucgccacggacaccgacaacgacuucgugaccaaccagaacaccaaguucacgcccgugggcgucauccaggacggguccaccacgccccgcaacgagccccagcagugggugcugccgagcuacuccggccggaacacccacaacgugcaccucgcccccgccgucgcccccaccuuccccggggagcagcugcuguucuuccgcagcaccaugccgggcugcuccggguaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggcuacgugaccgucgcgcacaccgggcagcacgaccuggugaucccgcccaacggcuacuuccgguucgacagcugggugaaccaguucuacacgcuggcccccauggggaacggcaccgggcgccgccgguga

SEQ ID NO: 12432 - RNA, 1617 nt, Artificial Sequence
  derived and/or modified sequence opt1 from VP1__Norovirus_and/or_Norovirus-like__KC517365
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggacaccacccagcucagccccgucaacaucugcacguuccgcggggacgugacccacaucgccggcucccggaacuacaccaugaaccuggccagccugaacuggaacaacuacgaccccaccgaggagaucccggcgccccucggcacgcccgacuucguggggaagauccagggcaugcugacccagaccaccaagggggacggcuccacgcgggggcacaaggccaccgucuacaccggcagcgcccccuucaccccgaagcugggcagcgugcaguucgagacggacaccgagaacgacuucgagacccaccagaacaccaaguucacgcccgugggggucauccaggacggcgggaccacccaccgcaacgagccccagcagugggugcuccccuccuacagcggccggaacgugccgaacgcccaccuggcccccgcggucgcccccaccuuccccggggagcagcuccucuucuuccgcuccacgaugccgggcugcagcggcuaccccaacauggaccuggacugccugcucccccaggagugggugcagcacuucuaccaggaggccgcccccgcgcaguccgacguggcccugcugcgguucgucaacccggacaccgggcgcguccucuucgagugcaagcugcacaagagcggcuacgugaccgccgcccacaccgggcagcacgaccuggugaucccgcccaacggcuacuuccgguucgacuccugggugaaccaguucuacacccucgcccccauggggaacggcacgggccgccggcgcuga

SEQ ID NO: 12433 - RNA, 1617 nt, Artificial Sequence
  derived and/or modified sequence opt1 from VP1__Norovirus_and/or_Norovirus-like__KC517360
augaagauggccagcaacgacgccucccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccgccaagggcgacgggagcacccggggccacaaggccacggucuacaccggcagcgcccccuucaccccgaagcugggguccgugcaguucgagaccgacacggagaacgacuucgagacccaccagaacaccaaguucacccccgugggcgucauccaggacgggggcacgacccaccgcaacgagccccagcagugggugcuccccagcuacuccgggcggaacgugccgaacguccaccuggcccccgcgguggcccccaccuuccccggcgagcagcuccucuucuuccgcagcaccaugccgggcugcuccgggugccccgacauggaccuggacugccugcucccccaggagugggugcagcacuucuaccaggaggccgcccccgcgcagagcgacgucgcccugcugcgguucgugaacccggacacgggccgcguccucuucgagugcaagcugcacaaguccggguacgugaccguggcccacaccggccagcacgaccugaucaucccgcccaacggguacuuccgguucgacagcugggugaaccaguucuacacccucgcccccaugggcaacggcaccgggcgccggcgcuga

SEQ ID NO: 12434 - RNA, 1617 nt, Artificial Sequence
  derived and/or modified sequence opt1 from VP1__Norovirus_and/or_Norovirus-like__JX846928
augaagauggccagcuccgacgccagccccuccgacggcagcaccgcgaaccuggugcccgaggucaacaacgaggugauggcccucgagcccguggccggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucacggccggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagcugaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcacgaagcccuucuccgugcccguccugaccguggaggagaugaccaacagccgguuccccaucccccucgagaagcuguucaccggcccguccagcgccuucgugguccagccccagaacgggcgcugcacgaccgacggcgugcugcucgggaccacccagcugucccccgucaacaucugcacguuccggggcgacgugacccacaucagcggcucccgcaacuacaccaugaaccuggccagccagaacuggaacagcuacgacccgaccgaggagauccccgcgccccucgggacgcccgacuucgugggcaagauccaggggguccugacccagaccacccggacgaacggcuccacccgcgggcacaaggccaccguguacaccggcagcgccgacuucuccccgaagcugggccgggugcaguucgccacggacaccgacaacgacuucgagaccaaccagaacaccaaguucacgcccgucggggugauccaggacggcaacaccacgccccgcaacgagccccagcagugggugcucccgagcuacuccgggcggaacauccagaacguccaccuggcccccgccguggcgcccaccuuccccggcgagcagcuccuguucuuccgcagcaccaugccggggugcuccggcuaccccaacauggaccuggacugccugcucccccaggagugggugcaguacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacgggacgggccgccgccgguga

SEQ ID NO: 12435 - RNA, 1617 nt, Artificial Sequence
  derived and/or modified sequence opt1 from VP1__Norovirus_and/or_Norovirus-like__JX459904
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccaggggaugcucacccagaccacccggacggacggcuccacccgcgggcacaaggccaccguguacaccggcagcgccgacuucuccccgaagcugggccgggugcaguucgccacggacaccgacaacgacuucgucaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagaccggguacgugaccguggcgcacacgggccagcacgaccuggucaucccgcccaacggguacuuccgguucgacagcugggugaaccaguucuacacccuggcccccaugggcaacgggaccggccgccgccgguga

SEQ ID NO: 12436 - RNA, 1617 nt, Artificial Sequence
  derived and/or modified sequence opt1 from VP1__Norovirus_and/or_Norovirus-like__JX459649
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguucagcaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacauccccggcagccgcaacuacaccaugaaccuggccagccagaacuggaacuccuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12437 - RNA, 1617 nt, Artificial Sequence
  derived and/or modified sequence opt1 from VP1__Norovirus_and/or_Norovirus-like__JX459643
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccgggucgaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12438 - RNA, 1617 nt, Artificial Sequence
  derived and/or modified sequence opt1 from VP1__Norovirus_and/or_Norovirus-like__JX459602
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccucccucgacuucgacuucaucuuccuggugccgcccaccguggagagccgcaccaagcccuucacgguccccauccugaccguggaggagaugaccaacucccgguucccgaucccccucgagaagcuguucaccggccccagcggggccuucgugguccagccccagaacggccgcugcacgaccgacggggugcugcucggcaccacccagcuguccccggucaacaucugcacguuccggggcgacgugacccacaucgccgggagccgcaacuacaccaugaaccuggccucccucaacuggaacaacuacgaccccaccgaggagacgcccgcgccgcugggcacccccgacuucguggggaagauccagggcguccugacccagaccacgaagggggacggcagcacccggggccacaaggccaccguguacaccggguccgcccccuucacgcccaagcucggcagcgugcaguucagcaccgacaccgagaacgacuucgagacccaccagaacacgaaguucaccccggucggggugauccaggacggcgggaccacccaccgcaacgagccccagcagugggugcugcccuccuacagcggccggaacguccacaacgugcaccuggcccccgccguggcgccgacguuccccggcgagcagcuccuguucuuccgcuccaccaugcccgggugcagcggcuaccccaacauggaccuggacugccuccugccgcaggaguggguccagcacuucuaccaggaggccgcccccgcccaguccgacguggcgcugcuccgguucgugaaccccgacaccgggcgcguccuguucgagugcaagcugcacaagagcggcuacgugaccguggcccacaccgggcagcacgaccucgucaucccgcccaacggcuacuuccgguucgacuccugggugaaccaguucuacacgcuggcccccaugggcaacgggaccggccgccggcgcuga

SEQ ID NO: 12439 - RNA, 1617 nt, Artificial Sequence
  derived and/or modified sequence opt1 from VP1__Norovirus_and/or_Norovirus-like__LC177655
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggcgcgcgccccugggcccggaccucaaccccuaccugucccaccuggcccggauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccgccagcuggagcccgugcucaucccgcugcccgacgugcggaacaacuucuaccacuacaaccagagcaacgaccccaccaucaagcugaucgccaugcucuacacgccccugcgcgcgaacaacgccggcgacgacgucuucaccguguccugccgggugcugacccgcccgagccccgacuucgacuucaucuuccucgucccgcccaccguggagucccggaccaagcccuucagcgugcccguccugacgguggaggagaugaccaacucccgcuuccccaucccccuggagaagcuguucaccggcccgagcuccgccuucgucgugcagccccagaacgggcggugcaccacggacggcgugcuccuggggacgccccagcucagcccggucaacaucugcaccuuccgcggcgacgugacccacaucaccggcucccggaacuacaccaugaaccuggccagccagaacugguccaacuacgaccccaccgaggagauccccgcgccccuggggaccccggacuucgugggcaagauccaggggguccucacgcagaccacccgcaccgacggcagcacgcgggggcacaaggccaccguguacaccggcagcgccgacuucgcccccaagcugggccgcgugcaguucgagaccgacacggaccgggacuucgaggccaaccagaacaccaaguucacccccgucggggugauccaggacggcuccaccacgcaccgcaacgagccccagcagugggugcugccgagcuacuccgggcggaacacccccaacguccaccucgcccccgcgguggcccccaccuucccgggcgagcagcugcuguucuuccgcagcaccaugcccgggugcuccggcuaccccaacauggaccucgacugccugcugccccaggagugggugcaguacuucuaccaggaggccgccccggcgcagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggaccggccggcgccgguga

SEQ ID NO: 12440 - RNA, 1617 nt, Artificial Sequence
  derived and/or modified sequence opt1 from VP1__Norovirus_and/or_Norovirus-like__KP784698
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacggacggcagcacccgcgggcacaaggccaccguguacaccggcuccgccgacuucacgcccaagcugggccggguccaguucgccaccgacaccgacaacgacuucgugaccaaccagaacacgaaguucaccccggugggggucauccaggacggcagcaccacgccccgcaacgagccccagcagugggugcugcccuccuacagcgggcggaacacccacaacgugcaccucgccccggccgucgcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacguggcccuccugcgguucgucaaccccgacaccggccgcgugcuguucgagugcaagcuccacaagagcggguacgugaccgucgcgcacacgggccagcacgaccuggugaucccgcccaacggguacuuccgguucgacuccugggugaaccaguucuacacccuggcccccaugggcaacgggaccggccgccgccgguga

SEQ ID NO: 12441 - RNA, 1617 nt, Artificial Sequence
  derived and/or modified sequence opt1 from VP1__Norovirus_and/or_Norovirus-like__KX354104
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaucggcuccgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccagcuacuccggccggaacaccccgaacguccaccucgcccccgcgguggcccccaccuuccccggggagcagcugcuguucuuccgcagcaccaugccgggcugcuccggcuaccccaacauggaccucgacugccugcugccccaggagugggugcaguacuucuaccaggaggccgcccccgcgcagagcgacgucgcccuccugcgguucgugaacccggacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccgccgguga

SEQ ID NO: 12442 - RNA, 1617 nt, Artificial Sequence
  derived and/or modified sequence opt1 from VP1__Norovirus_and/or_Norovirus-like__KR904211
augaagauggccagcuccgacgccaaccccagcgacggcuccaccgcgaaccuggugccggaggucaacaacgaggugauggcccucgagcccguggucggggccgccaucgccgcgcccguggccggccagcagaacgccaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcacgaagcccuucagcgugcccauccugaccgucgaggagaugaccaacucccgguuccccaucccccuggagaagcuguucaccggccccagcuccgccuucguggugcagccgcagaacgggcgcugcacgaccgacggcguccuccuggggaccacccagcucagccccgugaacaucugcacguuccggggcgacgucacccacaucgccggcucccgcaacuacaccaugaaccuggccagccagaacuggaacagcuacgaccccaccgaggagaucccggcgccccuggggacgcccgacuucgugggcaagauccagggggugcucacccagaccacccggacggacggcuccacccgcgggcacaaggccaccgucuacaccggcagcgccgacuucucccccaagcugggccgggugcaguucgccacggacaccgacaacgacuucgacgccaaccagaacaccaaguucaccccggugggggucauccaggacggcgggacgacccaccgcaacgagccccagcagugggugcugcccagcuacuccggccggaacauccacaacgugcaccucgcgcccgccgucgccccgaccuuccccggggagcagcugcuguucuuccgcagcaccaugcccggcugcuccggcuaccccaacauggaccucgacugccugcugccgcaggagugggugcaguacuucuaccaggaggccgcgcccgcccagagcgacguggcccuccugcgguucgucaaccccgacacggggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcaccggccgccgccgguga

SEQ ID NO: 12443 - RNA, 1617 nt, Artificial Sequence
  derived and/or modified sequence opt1 from VP1__Norovirus_and/or_Norovirus-like__AB933743
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgccggugggggugauccaggacggcuccaccacgccccgcaacgagccccagcaguggguccugcccagcuacuccgggcggagcauccacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggcggcccccgcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12444 - RNA, 1617 nt, Artificial Sequence
  derived and/or modified sequence opt1 from VP1__Norovirus_and/or_Norovirus-like__LN854572
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugauccacaucccgggcagccgcaacuacaccaugaaccuggccucccagaacuggaacagcuacgaccccaccgaggagauccccgcgccccuggggaccccggacuucgucggcaagauccagggggugcucacgcagaccacccggaccaacggcagcacgcgcgggcacaaggccaccguguacaccggcuccgccgacuucagccccaagcugggccggguccaguucgccaccgacacggacaacgacuucgagaccaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggccgccgccgguga
